United States Patent 12,376,589 (CHRYSEOBACTERIUM INSECT INHIBITORY MICROBIAL COMPOSITIONS AND METHODS OF MAKING AND USING) - sequence listing, part 2

SEQ ID NO: 18 - DNA, 152389 bp, Chryseobacterium sp.
actcaggagtagtttctaatagtatggggactgtagaatcttgttcttatcaaacagtagatatgtatttctcttgctatacaggagaccataaccagactaatgaaagtacttggggcagttgcaattggcaaagtcagggaggttatcctgcccaacacctaaccgtagtagcattagtttgtacagctagcacagctttaggagatgacggaactgcaggaggaggtgaattaggacccactacaggcttaggaagcggaacaaatgatggaactcctacaaccccgactctcacactcccaaaaaatacaccttgtgggaagataaaaactaaatttgcaaatgcaaagtttaaagaaaaagttgaagcgcttgataaacctgaaatacttgcttatgaccatgaaatgggatatgccgctggataccctcctgcaaatacaggtattacagaaacacaatatcttccaatggaaaattctataggaacccataatgtaagactacccgcaggcaatcaattctttggttatatgcatacacacaacaatgaaagtggcgatagcactcccattaaaatcttttcacccgctgatgtgataacttttttaacaagttgcgtaagaaatgcagatgaccacggaaatataggtgatgcttatgcaatggttataacttcacaaggaaactatattcttcaatattctggacttgcagattttaatattggacctaaccaaataaacaattggaatacttggtataaaagagagtttcaaaagttagctgatgaagataaacttacccagccaaacatagaaaaaacttttgcacgatttttaacagaaagtgttaagataaacgggctagaagtttatcaagtagaaaaaataacgggtaatgcttctaaaattaatacagatggtactaaaaccccatgtccttaaaaacaaaaaaaatttaattatgaaaaatatatttttaattattacattattgactttgacaatctcttgtaaagcacaaacttatccattaagaacctatggtatagaaacataccctgcgaactcctacctcaaagatttaaacaatgaacttcctgagtatgaaggaacttggaaaggaacttggaataacaaaacaatctatattattttaaagaaaataaaaagaaatttcacacatttagacaataacccatactatatggatattctaattgggaagtttaaagttacagactcaaatggctccatattatttgacaatacaaatatttctgacgaacaagcaaaaattgaaggaggcaaatttggaaaatctgacggaaaatattctttaacttatacagattctgaaatatgtaatataaacggtttaataaaaatttactttacagattcaactaaaactaagcttaattggaagttttctgatatgacggatattattaccccagattgtccttattacaactctaatccatttcctgagccattacctaaaagcattatattaactaagcaataactataactttaataatttaataatgattggttctaccatagattgggtaaagccaatcattttattctaaagctattgctgttaattgtgaacgtgcagttagattcaaattttccaaactaataaaatatatatgaaatacttattttttatactaacattttttgctatttcatgtaatgctcaaatcatttcattagaacaagcggcacaatgtctaacaaatcctaattgtccacaatataactatgcaaaagatattaataattctctagataaatataccagcacgtggaaaggaacttataatggaaaaacctatgagattcaactcaaaaaaggtatttatgaggagataggtattagaagagacaatttaattggaagaatgaaagtaactgattctaacggaaatattatctataatacctttactgaacctaatgatataaaaacaaattttgacggattgaattttcaacccgatttaaaagcgtatagaatgagctttgtaggtaacagtgaatttgcttgtggcgaggaaggaattgtttatttaagaattaagccagaaacacccaataaaatgagtatacttatgttgcaggatgctgatattacttggggaaattgtccgtctagctaccaacctattataccttacaagacatcaatatctttaataagacaataggctaaaggtttttaaataattaaaaaatgattgatattaccacaatatcaaggcaagatcaatcattttttatcctaaaactatttatagaggtgtgataattattactaatttttattccaacccaaatgacctacattttgaatatctactatatagcagaataatatattgtattgaccaagcaataatttccattttcttactataccatataaaaaatcaaaaaaaattatttcttgatgtatgataaggtgcctcccaataggtttttctatttttgtacccgaaaacaacaaaattcaaacttttttaaaacagttcaatatgaaaaaaattagcgtaattgcattagtaggagtaggattgcttttagcatcatgtaataaagacaaatcggcagaatctgcagctacagctcaggagcagacggtagcagaaagcaaaggtgaaactcttgctgtggatacagtagcttcagtagtaaactggaaagcattccataaaggaggtatggcacctcgttggggaacacttactgtaaaatcaggagatatcagtgttgatgcaggtcaggttgcagcaggaaactttattatcgatatgaattctattaaagtagatccggcttcagtaactgagaaagataaaaagccggcagatcttgaggctcaccttaaaaatcctgatttctttgatgtagcgaaaaaccctacttcagatttcaagattacaagtgttacagatctgaaagaagcgccaaaagatgcagtagcaggagctaataaaacagtaagcggaaaccttacattatcaggaaaaacaatgaatgtaactttccctgccaaagtagatgttactgaaaactcagcagctattcaggctaaattcactgtaaacagagcagattggggaatcaaattcggtacttcagaagcagatcctgcagaatggatgatcagcaaagatatcgagattgcaattgatgtaaaagctaaaaaataagttattcaactttaataaatagcgggctgtcttgataaaaggcagctcttttatttctgtgaattctctcaaaaaaaactaattcaaaatctcagaatgttgaattctcacgcaatattcacttccaagatataagggattgccatgcttttctgaccagaatccatccagaacattcttattcagacagcggtaaacagccactcctttgtagattttattatcttcaccttcataattgaagttaattactaaaatctgatctttataaaatccggtaccattttgtatatgatcaccaataatccattgggcaatgatgcggttgttctcatcaatggttagggttaatataccatgatatgtgggcagggaagattcttcctgattacttccttcaatagaatagcttcccgcaagatcctgtactgtcattaattttatttttaggaagtgcaaatttataaaatcctgttctgaaattaaactctacttttgcagcaaattaattttaaaatgattccttttctttttgtcatcaatctaattacatttggaacttttggctttgataaatggcaggctaaaaaacatcaatggagaatttcagaaaatactcttctagggatttcgcttttgggtggaattttaggtgcggcttccggaatgattcttttcaatcataaagtttccaaaaaatcatttctggtgaaatttatattggtggtgttaattgatctggttttgttttaccgattgatgagacattgatataaagagtcttaagatgatttcgaaaaacagatatttataaaatcaatgttgtgttcattctgcttataaatttgtcaccaaatcattttaaatgacgttttctggacattctttttttatagttctatgagtaagcattttaaacaaaatattaaatatttagagaactaaatagtttttcattaaaaatcactacttttgcacccgtaaaaatcttttatgcaaaacattagaaatattgcgattatcgcacacgttgaccacggaaaaacgactttggttgacaagatcattcacgctaccaacattttcagagaaaatcaggagagtggggagttaattatggataataacgatcttgaaagagaaagagggatcaccattttatccaagaatatttctgttacttataaagacacaaaaattaacgtaattgatactcctggtcacgccgatttcggaggagaagtagaaagagtattaaaaatggctgatggggttattttgttggtggatgcgttcgaaggaccaatgccacaaacaagattcgtacttcagaaagctttggaattaggattaagaccattagtagttatcaataaagtagataaaccaaactgccgtccggatgaagttcacgatcaggtatttgatttattcttcaaccttgaggctactgaagaacagttggatttcccaacattctatggttcttctaagcagggttggttcaacacttcattagaacaaactgaagatattttaccattacttgacggaattttacaatatgttcctgctcctactgtaactgaagggaaccttcagatgcagatcacttcccttgattactcttctttcttaggaagaattgccatcggaaaagtgacaagaggagagattaaggaatctcaatggatcggtcttgctcaagcagacggtaaaattgttaaaggaaaagtaaaagagctttacgtttttgaaggattaggaaagaaaaaagtaacagaagtacaggcaggtgatatctgtgctgtagtaggttttgatgctttccagatcggagattctttcgtagaccttgaaaatcctgagccattggaaagaactgcaattgatgagcctacattgaacatgacgttctctatcaacaattctcctttcttcggtaaagatggtaaatacgttacttcaaaccaccttaaagaaagattaactaaggaattagagaaaaaccttgcattaagagttcagcagactgatgatgcaaatactttccttgtatttggtagaggtattcttcacttatcagttttgatcgaaactatgagaagagaaggttatgaaatgacgattggtcagccacaggttatcctgagagaaattgacggagtaaactgtgagccttacgaatctttagtagtagacgttcctgaagaattcgcttcaagagttatcgatttggctacacaaagaaaaggtgatcttcacattatggaaactaaaggagaaatgcagcatatggagttcgagattccttcaagaggattgatcggattacgttctcagatgctaaccgctactgccggtgaagctattatggcacaccgtttcacagaatacaagcctttcaaaggagctattccgggaagaaacaatggtgtattgatcagcaaaactacaggtccggctacagaatactcaatcaacaaactacaggatagaggtaaattcttcgttgatccgggtgaggaaatctacacaggaatgatcgttggagaacagaacaagcctggagatttggtagtaaatatcgtagaagcaaaacagctgaacaacatgcgtgctgccggaaaagataaggatacaggagttgctccgaaaatcttattctcactggaagaatgtatggaatacatccaggctgatgaagcgattgaggttactccgaatttcatcagaatgagaaagaaaatcctttctgaagaagaaagaaaaagagtagaaagatctgcaaaagcataataaaaattttatacataaaatcaaagcctcgaaaatcgaggctttttttctatacccacttattaaaatgcttattttggcataataatctctgagaaataaaaaataaattttaaagtagttttgtgactatgagaatgaataaattaaaacttatcgttttattaggtgtttttgcttcttacactacctcatgttccgttcagaacaatgttgtaaaaacaccttccacgaaaaatccgacaaaacccgccaacaataccaacccgccaaaagtaaatcctgctgctacaaatccttcaacaggaactgctgcatcagccgaagataatttcagaaccactcttccggaaattaaaagagaattccgtggagcatggattgcgagtgtagccaatatcaactggccttcaagaaatgaccttacagtagagcagcagaaagcagaggcaatcagtatgcttgatatgttgaaagataacaacttcaatgcagctatcttccagatcagaccttcagcagatgccctttatacaagcaatatcgagccatggtcatatttcctgaccggagaaacgggaacagcaccttctcccaactatgatccccttcagttctggatagaagaagcccataaaagaggcttggagctgcatgtatggttaaatccataccgtgcacatcataccaacggtggtgctgtcaataaactgtctatggtcaataaactgtccgatattgttgtcagattaaaaaacggaatgtactggtttgatcctgctaatccgaaaacccagggacacgtatcaaatattgtgaaggatatcgtaaaaagatatgacattgatgccattcattttgacgattatttctatccttatgcaacttataacaaaggcgcagattttcctgataatgcaacctggaatgcttatgtaagcagcggaggtactttatccagagcagattggagaagagacaatgtaaataaatttgtggaacgtatctacaaagaaattcacgcagaaaaaaataatgtaagattcgggatcagtccgtttggaatatggaaaccaggataccctgcaggaattgtaggctcttcacaatatgacgagctgtatgctgatgctaaattgtggttaaataaaggctgggtagattatttctcaccacagctgtattggcctattgattccaaagggcaaagttttgaggccctgttgagctggtggcagtctgaaaacaccatgaaccgtcacttatggccgggactgaatactgttgagatcaaggtttcagaccgcccaacggaaattaaaaaccaaattgctatttcaagaaatatcctgaaaaatgatgccggggaaattcactggagtattgcaggacttaccagaaatccaaatatgcttcctgctctgaaaagcggtccatataacgaaaaagcattggtgccgaaatctccatggataaaagctgccccattgcagactcctacattgtttattgctgataacggaagctttgtgcaggcaagctggagtacaaaaaatgctgctgatgtattcctgtgggtacttttcactcagtacaacggagtgtggcaaacagaaatagtaacactggataccctttcaaaagatattcctaagtctaaagacggtaaaaaactgaatgcagtagccattaaagccgtcgacagattaggaaatgaaagtgattatacagcaagaaaaattaaatagtggtataagacccgctccaataggtcattgcgaacctttaggcgaagcaatctcaacaataaatttaaaacccggttccgtcttagaaccgggttttattttagaataactataaattattaatttaaaatattgaaaaccagttgtgttttaaagtgtattgagcattttaaagtaaaatagaaactttatcggaatcatttttgcatagattattccataatcaccaaaatataacattatgaataccaaaagactttccgacaacatggaaaaggcattaagtgatcagatgaacaaggaaattcacgcgtcacacgtttttttatcctatggaatttgggctgatgataaaggatatcagggaattgccaatttcctttaccgccatgctcaggaagaaagaaatcattcaatcaaattcatggaatatattttaaacagaggaggaaaaccaaaagtagaagctatcccggctcctcccgcagatcctgaaaatcttactgcttgttttgacggggtttttaagcatgaagtagacaatacaaccgctatttacagaattgtagacctttccatggaagaaaaggactgggcaacatggaattttatgcaatggtttgtacaggaacagattgaagaagaaacattagctcagaatttaattgataaattgaaaattgccggcggtgacagagctactgatgaatctttatttactttagataaaactttacaggaagcacccaatgacgttccgctggctcaggaagctaccggagacaatccttaaggtcgttcggtgaaatccagacttttgaaaatctgtcagaacactggcagattttttattatgaaactcgttcaaaaatcactatctttgcgcactcgtaattcaaggttcggagttcaatgtttaaagttgcagaaaccttgggttgccactgaaccttaaactttgaattttacaatatgaaatgtggaatcgtaggcctgccgaatgtaggtaaatcaactctttttaactgtctgagtaacgctaaagctcagtctgcaaactatcctttctgtactattgagccgaacttgggaacggtttctgtaccggatcagagattgtttgaactggaaaaaatcgtaaaacctgagagagttttgccagctgtagttgagattgttgatattgcaggtcttgtgaagggagccagcaaaggagaaggattggggaaccagttcttagccaatatccgtgagtgcgaagcgattattcacgttttaagatgttttgataacggtaatattgttcacgtagaaggttcagtagatccgttaagagataaagagattattgatattgagcttcagctgaaagatcttgaaacagtaggaaaagcagttgagaaagctaaaaaattcatcaagtcagggaagaaagaagatatccttacttacgaaactcttcagaacttacagaaattccttgaggatggtaaaaatgcaagagaattcgctaccgatgactttacaaaatcaattatcggagaagttcagttattgaccaataagccggtactttacgtttgtaatgtggatgaaaattctatcaaaaacggaaatgaatggattggtaagattgaggaaatggctcagaatgaaggagcagaagtagttgtattggctgcacagattgaagctgatatcaacgagcttgaaacttttgaagaaagagaaatcttccttgaagaattaggccttacagaaccgggagttaaccgtttgatcagaaaagcttatgatcttttaaaacttcagacttattttacagctggagtaaaagaagtaagagcatggactatcgggcagggttggactgctccacaggctgcaggagttattcacacagacttcgaaaaaggatttatccgtgcagaagtaattaagtataacgattttatcaactacgggtcagaagtaaaagtaaaagaagccggaaaactttctgtagaaggtaaagaatatattgtacaggatggtgacatcatgcactttagattcaatgtataaataaaagtattaaagttagttataaagaaaagcgcttccatgtatttgggagcgttttttgcttttagattctcgccgttttaatttattttgtaattgaaattcataagatgcactgcataaaaaactgccctctgaaatcagaaagcagttcttgttgttttatcttatattatatacctgtatcgaatctgcattttgcttctatacaagctggagagaaaaccacacagttattgactatatctgtacatcttaactgtgattgaccacctctacattgtggttcatagcatgatgggtgggtttgtgtacatattgttccattttgtatgctacatatcattacacctcctttaatggttttcaactcttttttactgagttttttaccattatttaaatgttgatttctcattcgttgaagtttttatggtttagttttttctttactacaattcaattccgggctggcatcgtatttccgcacaggtaaaagaatattttttgcaggttaggtccggaagcaggcacatttcttttccacctgtaattactcttaattgttttttgttcaatttttttctgtgagttaaattttgatttttcatagtgtttgatttagtgattattaatataattcaatagatatgatgtcttaaggtctgcaaattttctgcgcacaacttggagaaaatatggtacagtttctaatatctccaggtggataggtttcgcaaggaaactctgtacacggaacagcctccatgcaatccagcaagcccccgtgaatcattttcaattgttttttttcaagctttttagctttgcttaattctgtctttttcatagctgttggtttaaaatgatattgagttatagctctggtctacattctttttgtgcacattttggagaaataattgtacatccatagggatcagaagaaggctcgcaaggtgttggacataaaactggttccatacagtttataaggcctcctttgatagttcttaattcttttttgtttaatttttttccaatttgactgatttgattttccattgttttgatttttagtgagttagttttaacgaatgtattaaaaataaatgaaatatatcacgacgcttagaaaaaaatgaattttttttaatatcttattacaatattgatatagattttaaaatgattctaaatcttattcagcataaaaataaaatgttctactttagatatttatttgaaaccggctgtttcataacttcgtatatttgaattttacaaatcatttgtgatggaaaaagtagcacatacttcactggaagacttttacaaggaaatggccgccaaactgggcaaagaccttgaaagtatttttccgaaaggacttcataaagacatcggtcactttaatgttttcgatattgcccaaactatagaacgggcaaaaaccacttcggaaatgccttataacagaagaaaatactataaaatcagttttataaaaggcagaaacagggcagaatatgcagacaaggtaatttctatacaacagaatgccttattatttgcaaccccaaaagttccttatcactgggtacctgaagatccggatcagtcagggagtttctgcgtatttacagaagattttttcattaaggacaaatcttattataaccttgaagatcttcccatttttcaacctggaggaatacctatctttgaaattgatgatgaacttgcagaagagattgaaaacctttttaaaaaaataaagaaagaaattgaatctgattacgtatttaaatatgatctgatccgaaactatgtgctggaattaatccactatgggcagaaattacagcccgcttccaaaatttcagcatccaatgatgcttccatgcgggtggtttctttatttatagaattgctggaaaggcagtttcctatcgaatcatgggagcagagactacaattgaagtcagctaaagattatgctgaccggctggcggttcatgttaattatctgaataaaagattaaaagaaagcacgggaaaaacaaccacggaatttatttctgaccgtattgttcaggaagctaaaatacttttgaagcagacaagatggaatgtttccgaaatatcttatgctttgggatttgaagaagttgcccacttttccaatttctttaaaagaaaaacaacctttactccattggaatttcgctcctgatttgaattttgcaaatttcagattgattcagacaaacacttcaatcctgaaatgtctcaactttgtatcatcaaaataatcaaaatacaatgaacacaaaaacaaatatcgcactggtaaccggaggaagccgtggattggggaaaaattcagcccttaaaattgctcagaaaggattagacgttatcattacatacagaagcaacaaagaagaggcggaagctgtggttagtgaaataaaattgatggggagaaatgccattgcatttcagctggacaccaaagacttaaaaagtttcgatgcttttgtaaaagacgtaacagatcatttgaaagaaaacaccggaagtacccacattgattatcttatcaataatgcaggtacagctttatattcaccaattaccgaagttacggaagagcagctggatgatgtggtagacattcacttcaaaggcgtatttttcctgactcagaaatttttaccatttatcaatgatggaggagggattatcaatatatcttcaggattggcaagatttgcaacgccaggatcttctgtctacggatcaataaaagcaggagtagaaatgttgacaaaatatatggctaaagagttgggaccaagaaaaatcaaagctaatgtggtggccccgggagcaattgaaactgatttcggtgggggaagagtaagagataatgaagaaatcaacgcaatggtagctggtgcaacagccctgggaagagtaggcctgcctgatgatatcggtggagtggtagctttcctgtgcacagaagatgctagatggatcaacgggcaaagaattgaggtttccgggggaatgtttttgtaacatttgaacggcctctcatattaaaaagaatcagccggctcattttgagccggctgattttatttaacctattgtcattagatctttgaaagattctcgagagccttttccagggtctcttttttcttggcgaaacataacctgatcacattttcattcagtttatttttataaaaagatgagaaaggaacactggctaccttatgattaatggtgagttcagaggcaaaatcaaaatcatttttatccgaaatcttatcatattttactgcctgaaaataagttccttcacaatccagcagttcaaacgaagttccttccagtccttttctcagaaaatctcttttttcctggaaaaattggcttagctggctgtaatgttcatcatttttcatgtattcagccaatgccagctggattggagtatttacacaaaatacattgaactgatgaacctttctgaattcatccgtaagacttttaggagcggcacaataacccactttccagcctgtgacatggaaaagcttcccaaaagaggctacaagcaggcttctttctttcagctcaggatatttgcatatgcttaaatgctgctttccgtcaaaaacaatattttcatacacttcgtcgctcagaataagaatggaagttccctttaccagctcaatcagctcctgtatatcattttctttcaggatttttcctgagggattattggggttattaagaataatcattctggttttttcgctgacaagcttttttactgcagtccagtcgatttcataatcgggagctttcatttcaaaacgtttcacaacacctccgaaaagctctaccgtgggttcataacaatcataagccggctcgaaaataatcacttcatcatctttttttacaaaagaagcaattgctgtaaaaatagcctgagttccacctgcggtgacagttatttcagaatccgggtgataaactgcctgatggctgttttcaatttttcttgcaatttcttcctttaagccgatcattccgccgagaggggcatactgattgaagccttttttgataaaatgatctacataattcaacagttcaggatcaggcataaaatcaggaaaaccctgagacaggttgatcgcttcattttcattggcaagctgagtcatctggctgaaaatagtagttcctacattggaaagttttgataaaggaagttgtatcataaaaacagttttgttgatcgaatttaatgaaatatttaaaacagtttgaacttaggacaataaaaatcgggaaatagtaaaggtaaagccaatattcgttaaagccttataagtttcaatgcaaaaattattttaaacatttgtttaaattttccttttgaatcaacataaatatatctacatttgtttgataaacagccattaaaaacgataacaatgaagattaagaaaacagagtttcctgaaaaatccgttttatcaaaaggaaaaaaagagttcgattatatcgatagttttgaaggagaatttacggatggcggccggaatattgatatctcagaaataggaaaagtattttttacaagcggacctaaatggggtaagagaatgtttgctttcaggaataaagcggtgggaatattcgggctaaagaccggctctgaatctgaaacacagcaaaaagaacaggattttaaatgtgaagtaggtgagcgtgcgggcctttttaaggtgtttgataaaaccagcaatgaaattgttctgggagaagatgataagcacctggatttcagagtatctcttttagttgacaggagtaaggtgcatcctgatgaacattcacttaccatttccactaccgtaaagtatcataactggctgggtgtgctttattttctgcctgtacgacctttccataagcttattgtacctgctatgctgaaaaatataattgtacagctggaaaataaaaaataaaatattgatctgcaaatacaaaagtaataatcgtcctgtaattgtaaacatcttaatgaaaattttcagggttaaaatgaattttatttgcttttgtatgtcaactaatttaaagggcttaaaaatcaacgagtattcttctcactggacaataaaagttaggaaaaaatgacttttaaaattcggataattttggacaattttgtatttttgtatgtttgctgaaatcatatatgtcacaagaaataaatccaacctattccgaagataatatcagaaccctcgattggcaggaacacatccgtctgcgccccggtatgtacatcgggaagctcggtgacgggtcttccgctgatgacggtatttatatcctgttaaaagaaatccttgataactctattgatgagttcaggatgagagcaggaaaaagaattgaaataaagctggacgacggaaaagtcacaatccgtgacttcggacgtggtattccactggggaaagttgttgatgcggtttcaaaaatgaataccggaggtaagtacgacagtaaagcttttaaaaaatctgtaggattgaacggggtgggtaccaaagcggtaaatgccctttcagattacttcagagtccgttctttccgtgacggaaaaatgaaagccgccgaattctcccgtggtatgatcaaagaaaactttgacgagaaagagacttcagacagaaacgggactgaaatttcttttatccctgatggagaaatcttcctgcatttcaagtacagaaaagagtatatcgaaagaatgctccgaaactatgcatatctgaatccgggacttaaaattcttttcaacggagaaacctattactctgaaaacggtcttaaagacttattggaagaagagctggaaagtgatatcctttatccgattgtccatttaaaggatgatgatattgaggtggctattacccattctgacaaatctcagacagaaacctatttctcgttcgttaacggacagaacacaacgcagggaggtacacaccttaatgcgttccgtgaagcatatgtaaaaacggttcgtgagtttttcaataaaagttttgatgcttcggatatcagaaaatctattattgcagcaatctcaatcaatgtagaagagccggttttcgagtctcagaccaaaacaaaattaggatctaatgacatgggaccgaacgggcctacagtcagaaccttcattatcgatttccttaaaagcaaactggataattttttacataaaaatccagaaatagcagaagcaattcagagaaaaatcttaatttccgaaagagaaagaaaggaactttcaggaattcagaagctggcaagggaaagagctaaaaaagtatcgcttcacaataaaaagcttcgtgactgcagacagcattataacgatcagaaagccgaaagaaaaggggatacccagatcttcattaccgaaggagattccgcatcaggatctattacaaaatccagggatgtagaaacgcaggcagtattttcactgaaaggtaaacctcttaactgttatgggcttaccaagaaagtggtatatgaaaatgaagaatttaaccttcttcaggcagctctaaatattgaagaaagtctggaagacctaagatataaccaggtaattattgctaccgatgccgatgttgatgggatgcacatccggttgctgatgattactttcttcctgcagttctttccggatctgattaaaaacggacatctttatatccttcagactcctttattcagagtaagaaataaaaaagaaacccgatattgctatacagaacaagaaagagtaaaagcattaaacgaactgggaaagaatcctgagattacacgatttaagggattgggagaaatttctccggatgagtttaagcattttattggtaaagatatccgtttagaacctgtagtagtaggaaaagaccagacgattgatcaacttctggaattttacatgggaaaaaacactccggacagacaaactttcattcttgaaaaccttgttgtagaagatgactcagatattgataaaaaagaaattctggatgaagttgaaaactaaaacttgaaacttaaaaactggttgtaaataccagtacattgactgaaaaaaacacaattttggatgaagtaagaattataaaacttacacagccaaaaaaataaaatgagactaagtaaccgcaataaagcatcgatttataactctctgagtacgttgcttttgatgataaccatgtttggtataatagcatttattgctaatgaataccggtttaatgcaataggtaatgaaagttatttattgattgttatacccattctgctgctgatcatattttacatcagcgggaggcagatttttgaatatgacagcgatggagaagctttgaattttaaaaacaggaatattattccttttttgaataaacctcttcacgatgaatttccaaaatacaaactggtaaaatatgatgtggtcagtattctctttttcaaaagattatacattaccgtttccagcaaaaataatggttctacgatacttaagtaccagatctcttatttgagtagaaaagaagtaaacgatttaaaactttctctgaacaaagtagtgaaagctaataaagataaaaaaacagatgacgacagaagaatattcgcatgagggtgaaagcttaaaaaaagtttccggtttatacaaagactggttccttgattatgcttcctatgtaattttggatagagctatcccttcgatatacgatggtttaaaacccgttcagcgaagaattatgcactctatgcgggaactggaagacggccgttacaataaagtggctaatatcgtgggaaataccatgaaatatcacccgcacggtgatgcttccattacagacgccatggtgcagatcgggcagaaagagctgttgatagacacccaaggaaactggggtaatatttatacaggagactctgctgctgctgcaagatatatagaagcaagactgactccttttgcgctggaggtggtctttaatcctaaaactacggaatggacaaagtcttatgacggaagaaacaatgagcctattgatttacctgtaaaatttcctttactccttgcacagggcgtggaaggtatcggggttgggctttccaccaaaatacttcctcataacttcaatgaacttatcaatgcatctgtagcctatttaaaaggtaaaaaatttgaactctatcccgactttttaacagccggttatctcgacgtttctgagtataatgatggccacagaggtggaaaggtaagagcaagagcaaaaattacccagacggataagcacacattggtgatttccgaacttccatactccaaaacaacaaccgatcttattgactctattttaaaagccaatgagaaaggaaagatcaaaatcaaaaagattgaggacaatacttcagataaagtagaaattctgattcatattcataatgatgtttctccggataaaactattgatgccctgtatgcttttacagactgtcaggtaactatttcaccgaatgcctgcgttatcgtgggagataaaccgatgttcatgaatgtatctgagattctgaaaatgaatacagatcatacggtatccttactgaaaaaagaacttgaaattgaacttcatgaacttcaggaaagctggcatttttcctcgttggaaaggattttcatcgaaaacaggatctaccatgacattgaagaggtgaaaacctgggaagatgtattaaagaccattgatgcaggattaaaacctcatacaaaacatctcttaagagccgttacagaagaggatatcttaaagctgacggagatcagaatcaagagaatttcaagatttgatttagataaatttaaagaaaatattgcatcgctggaaggtaagatagaacaggtaaaatacaatctggaaaacctgatcgcttatgccattgattattatttaaatattcagaaaaaatacggtaaagacaaacagagaagaactgagctcagaatttttgatacgattgatgctacaaaagtagccgtagccaacgaaaagttctatgcgaattttgaagaaggcttcatcggtacatcactaaaaaaagatcagtatttgtttgactgttctgatattgatgacatcatcacattcagaaaagacggaagtatgaaggtggtaaaagtggaagcaaaaacttttatcggaaaagatattcttcacgttgccgtttggaagaaaaacgacaaaaggactgtgtataatatgatctaccgtgaaggcagggaaggaccatattatatgaaacgtttctctgtaacaggggtaaccagaaatacagattatccgttagcttcagataaaaaaggttcggagacattgtatttctcagcaaacccaaatggagaagcagaaacagtaacagtacttttaaaaccgaacccaagaatcagaaaaaataaaatggagattaatttctctgatcttgccatcaaagggcgtgattccaaaggaaatctggttacaaaatatgctgtgaagaaagtagacctgaaggaagaaggagtttctaccctggctccaagaaagatctggtttgatgataccgtaagaagactgaatgcggatgcaagaggaacattactgggaagcttcaaaggagatgacaaaatccttaccatcaatacaaatggtgaagtaaaactggtttcttttgatcttggcaatcgttttgatgatgaatatctggtactggaaaagtggaaacctgaacagccgattacctgcatttattatgacggagaaaaagacatttatttcattaagagattcttactggaaaatacggttaatgtacagacctttatgccatctgaacatcctaaatcctttattgaaaatgtaattgttgccaatgacgccacagcagaaattatttttgccaaagataaaggaaaagagcgcgagccggaagtcgtgaatattgatgaattcattgctgtaaaaggaataaaagcaatcggaaaccagtttaccaagttcaaagtgaaagctatcaatattaccattcctgaacctgtagaagaagagcctgaagcttatgaagatcctgaaccaacaggtgatcttgacgaagatggaggaatgatcggagatctgtttcaggatgacgggaataatgaaaatgaatagtgatctgcctgttcccgtataatataaaaaaatatcatggatataattgttatcattatcattgctgctacatgtatcttcagctacatggggtttaataatacagcattatttgaaaaatataaattcaatgtcgcggctattgccaaccgaaaggaatatatcaggctgatcagctctgcgtttttgcatgctgactttatgcatttatttttcaatatgctttccctgtattttttccagggtgtagttattagtttctttggtgaaacaggatttttaatcctttatttcggatccatgatccttgggaacttattcagtttgcagatctataaaaatcagccgtggtattccgcaatcggagcatcaggagcggtttcaggaattatctttgcttctatagcaatggctccgaatgagattagtgtcaacttcttaccgggatggttattcggagctctgtatttcggatattcagtatatatgatgctgaatccaaagcagtgggataatctggggcacgcagcccatcttggaggagcgttcttcggattggtttactctattgtaatgcatccgcagctggccatgagcaacagccttttcctgggaataatgtcgctcccgctgatttatttaggatatgaaatctttgtaaggaaacgaataggataaaggctatttcaattaaaatatcaaaaccaatgaacacatcagagttaaacagtttcatcgtgatacttatctatggttcattggttttgctttctctgctgaagctggccaatcctttgaaagtaaaccataaggctaatttctggtttggcatatttctttttctgtggtctactttttggctcgatgaagttctttttctcattaccggctcaatagtagaattccattctctcttttgggtcagatgtattcagttttttacacccattgttttttactttagtgtgctgttctataccaacccttcctttacctttaaaattactgatgtaaagtttttattgcttcctgcagcttttctgggatgtcttatgatggtaaaactggggtatgagacaccgtttcagtacataagtattattttaatcctgatacaggcttttttctataccctgctttcctatattaccatcagaaaacaccaaaggagaatccagcagttttcctccaacacggaagggatcaatctgaactggctggagtatattatcctggtaatgcttatcgtaaacatcatctatatcatttataacctgttctacgatccgaaatccctgaatttctttatcaacactgtttttttacttgtgatctactgggtaggatactactctatgaaacaaagagagatttatcctctggaagaaaaacagagagaagaactgatctctattaatgaagattccggttcggaagaagtaaagagaaaactgatttctgatgaggaattgttaaaaattaaaatttcccttcaaactctaatggaagtgcagaagccttatcttgacagtgaactgaatctcatcaggctggcagaaatgctgtccgtttctacccatcatttatcttatgtcatcaatacgggcttcgggaaaaatttctttcagtatgtcaatgaatacagagtagactatgccaaaaaacttctgaaagagccggacagcaaattatccattctgggaatcgcttacgaatccgggttcaattccaaaacctcttttaatactacctttaaaaaagtgaccgggcaaactccttccgagtttaaaaaataagttcagttttataagttttaactttttaatgagtttaaattattgatttttaacccattaaattttggatgttttttattttaaaatacgttcgtccggataaaactgaacatcagaacgttgttcacatgatagctttgtaccataaaatttaaacttatggataccaaagaatcatatgcggtagtaacgggagcaagtcagggacttggaaaatcattcgctgaacatcttgcaaaacaaaagatcaaccttatccttgtaagtcttccacatcagaatcttaaagaactttcccgggaactcgaaaagctgtatgaagtaaaagttcattattatgaaacagatctttccgtgaatgaaaatgtcatgaaacttaccgaatggcttaatcagtcttttgccattcatatcctgatcaataatgccggacttggcggaactaaaaaattcacggaagcctcttctgattatatcaataccattttgcaggtaaatgttgcggctacttctttaattacccatcagcttcttaccaatcttttaaaacaacccgaagcttacatcctgaatgtttcaagtatggcagcattttctccgataggctttaagacagtatatccggcatccaaaagttttatccattccttttcaagagggctgcgcgaggagcttaaaggtactaatgtctttgtaagcgttgtcaatcctggtgcgatgaaaacgaatacggatgtatgcaaaagaatagaaaagcaaggctttataggaagattaacgcttttaaatcatgataaggtagcttcttactgtatccggcagttatttaaaaaagattccgtaattatggtgaacccaatcagttggctggtgataaaaattttaccaatatggatcaggctgccattaatgacccaggcaataaaaagagagatcgaagcatgaaaaaaatttgcgtaaccggagctacagggcttctgggaactaatgttatccttaaattattacaaaatggttattctgttattgctctggtgcgcaagaaaagcagctggctgtgtgaagaaaaagaaaatctgaaacttatagaatctgatcttttatccgatgtttcaacacatcttaccaatatcgactgtgttattcatattgccgcagaaacacgtcagaatcttatcaattatgatgaatacaggaaagtgaattatgaaacggttgtaaatctgtcgaagtatgcagagataatgggggtgaaaaagtttttatttgtaagcacggcaaataccttgggtttcggagagacagcgctctggggaagtgaaaaagcacctcagatatacccttttacctattcctggtatgcccaaagcaaattggctgctgaagattatcttttaaaaaatattaaaaatactgaggtgatcattgtaaatcctacttttatgatcggtgcgtatgacagcaagccaagttcaggaaaaattattttctgggcctggaaaaagaaagtaatattctatccgaaaggaggaaagaactttgtacatgtggaagatgctgccatcggaattgtgaatgccattgaaaaaggacggaatggtgaaaaataccttttagccaacgaaaatttgagctacagagaatttttcaggaaagtaaaccggattactggtcaaaagcctgttatgatagctattccagacaaggtgttgaactttcttggattggttggtgactatttgcgaaaattaaaaataaaaaccaatctcagctcttctaatatgaaggcacttcagatccgtaattattataacaaccggaaatcggtaaaggaacttgggataaagtatcagcctgttgataaagcaattgaagatgctgtccggtattttgttaacaataaaaagtattgatttacttgttaaaaataaaaaccagctgctgagagctggttatatcaaattatcttataattttctgagttacatttctgttggaaatgacacaggctttactgcagttatttgaacttgaaatattaacctgtaccagtgcaggcaatgatctgtattcttctgtattgtaaggagcttcagtaccatttctgccaccacctttaatgtcatactgtatctgagccacaccggtaaacccggcggcaggtttgaaagaaagcgctccggtagtaggaaaataagtccacgttccctgactgttcgtataaacatttccggttatattcggaatcacagctccattactgtccaggaaacggaatgaattaaaatcaagattattatacgaaagtgttggcggattctgaccgtttgctgaagagtaagctgcatcatttagcaaaggataataagttgattttattccgggacagcctgcaaacagatcatccgttacttcagctgcataaggtctcgtcacgcccaggtttttcaataaatgtatatttttggcagctccggtagaagccgcaaaaccaattctgaaagtagcgggaggtgaagtatccagcgttcttactgtggtgttggatattgtggtttctgtatatttaagagaggttggataataataattatcaatcactttttctttcacagttccatgctgtatttccagggtaatattgtaacctccggcaggattgggtaccaacgtaatataggctttacggaatcttgcatcattttcattctgaggaatggtagttccgccgctttcaatactgaactgctgaagattcggatttttaataccgatatactttcccgtctgggtatccagataagcagacctgttgctgctgtaaggagctgcattggtagcaatactgtaaagcagaggataaccattgtatccggcaggctcagctgatgacagatattggtttccgcgttttgcccttaaagacacattacttcttccatctgccagtgttactccaaaaattccatttcttacacgctctccttgtttaaagcttgttttaaaattcccgaattcatccagaccaattcccaggtaggctcctctcaatccttccgtagattcaccaccacgtacaaaactatatcccaatcctccgccgaagtagccgagattgagctgctctttgggaatggaaccatctaccagaaatatcgaaataccatctcctccgttagtatttcctccataaatggcaaattcaaactcgaacttgataccctgatcacttttaaatatcttgtcagccaatatcactcctccggaaatattatttacactccgggtaagcctaagaccatccgtggtaaaggttgcatcattctgaacaccactggtagaaaccttataagcttcctgaggctgtaatccctgtgtgaaattgacaaaataaggataaccggttccctgttcattctgagccttgatattctgggtgaatatcattacgggaagcatcaacaaaaaccttttgcattgtacaattgaggtactttttatcatagctcattatttaacaacaaaaacaatattgatgaaagaacagtctgttgctgctgctttaacgtcgtaagtcattacaccatcatcagaaatagaaatattgctgaatacattaggatcagcatcggttacgtaatagtaaaggtccttgcttgaagggaaaaaaggaattgaagcaggagcgctggtactctttgcttttggagaaccaaactgcgttttatataaagtatataaatctttagtcctgccgttcgctgtgattgaagtgtcaaaagaaacacttggcatgtaaaacatttttacagcattactgctgatacatagccagtcaggcttggctggagttcctatattctggctcagacatttcttgtcggtgtcatagataagaagtgagttggccggattggtaatcgcatctctttttgctgtagtaagtcttggtatcagtattcctttattctgactgtaaatgtccagcatggcactttcgtcaggtgtagggatgttaatacctacttgggcaaatgaaaatgaacttactaaaacgattggtagaaataattttttaatcataatgaattaataattttttatctgtgtatttttatgtgtttatattgtgtttttatgaagaatcagtcaattttaatctcaatggacataattatctttgacaattcatttagaataatcatttgtactgatttaatggcataatggggttctcaggtccaaagccaataaagatttaaaatgcaggtcttcatgagaccataatatggctttatctgaaaatatctactaagtaaattgatgtaagcagacttttatattgaatatacggcggtgtaccagtgaaaatcataatttttgtgttttttgcaaatatacgaataaaatactaaaaaacctgctttaaatagcttgtgagttgatttaacactatttgttagttaaattaatattttttaatttaaatttttattaagataacaagatatgtagattgtttttaatgtataaaatgttgaattaaataaaaataagtgtaaaataggaaatacagagaaacattattaaaacatcaagtttgttatgaagcgttcacattagtaagaacgcttcgcttaagacttaaaatcagaatgatgaattaacttcagaaatttattaaaggtgtattttttcagctgttttctaaacagctgaaaatgttattgagagagcttttctaatgcgtcctctaataatcctacaaaattgacatgttttgttttattactttcaaaaataaaatcctttatacttttactttcgtatttactgaaatcaccaacaatagctaatcctatccgatagttggagaatttctgcaggatttcacccgcaatttttgtttttaaatcgaagaattccggagtgatgtttttctcgtaaagaattactttgtcaaacccctgataataaatgtttcccatgagatcaagcccatcttgtgcagactgtataattatgctgtcagaaataatttctgcaatctttatattgttgatttcgtgtggttgaataatcatatttattgtattgttttttttatgtcgtataaaaagttccctaagggaaatgtatctccctgattggtaagcgcaataatgcagctgttatgcttcaaatctctccagaataaggctttaaagccgttcagaccccctgtatgcattgctgattttcctccgtttttattttctaagaaccatgcaaacccgtagtctgagatctttgcattggacaattggaagggagaatacatcatattggtattttctttattaattaaggcatagtttcgtaaagcacgatcaaatttataaagatcttcaggagtagagtagattccaccatcaccggttgttaaaattgaataatcatcaggctgtttttgtttattatatcctgctgctctgttctgaataactgtaccaggttcatacacataagtgttacccatttttaaagaagtaataatctgctcattgataaatgtgctgtaagattttccggaaaccttttcaatgatctgagacagaatgatgtatccgctgttgctgtacttaaattcgctgtcaggaatgaactcaagatttttaagatcaaacagccagttcattacttgctgattggttaatccctttttagaaaacagattttcataatccctgattcccgaagtatggtgcaaaagctgtctgaccgtaatgtttttagcatattcaggaagctttatgaattgggaagctttgtcatcaaatttcaataaacctttttgctccagcatgataatagctgctgcagtgaatggcttactgagggatgcaatataaaatgaagtgtttttgcctgccttcagttttttttcaaagttgcgaaatcccagagcagtatcacagacaatctgaccgtttttcacaatcagaaccgagccgttgaattctcctttattgtaatatccatttataacatcctgaggattctgtttgcaggataccagctgagtaatgagtaaaacaaagatgaaaaagttccatgtcaaagttttcataggttatgtatatggaagtaaaattacttatttccttccataaataaacctgtcattttcagataaatcctttaataattgaacgttagaaaaataatgatacaggcccagcgtttcgggacctaatttctgattgatttctaaaaataaaagtccatcctctgataaatattttttagcatcttctgcaatttttctgtaaaagatcaaagcatcagcagtaggggagaaaagagccattttgggttcaaattctttcactgaatctgcaatttcaatctcttcttcaatcccgatgtatggcggatttgaaatgataatatcatagtcttcacccagttcataattaagataatcggcgtggatgaaattgatctccagctgatggtactctgcatttctttttgcagtgttcaaggctttttcagaaaaatcaacagaggaaacatgggcttcaggaaaatacttctttaagaccagagggataattccgcttccggttccaatatccagaatctttatatcctgatccttaaactttgaatttttgatctccctgatcgcaatttccagcagttcttccgtttcaggacggggaatcagtacattttcatctacgaaaaatttcattccgtaaaattcggtttcacccaatatctgctggtaaggtttcccggttttaagttctgatacaagatggctaagtttttcttcatcagctgttaaaagttcctgttcggaaaatcttctttgctggaaattatcaaaacctgtaatctggtgaatgaacaaagacgataaaaatgcactttccgactcagtataaaggctggaaagttctgctttgaaatatcttttaaaggctgaaattgtcatttatcttgtaaaaaccagttttgtatctgtggacttttcttcattaattctgtatccttcatagttgaatgcttttacatcctccagagttttggcgttggtttctgcacagaatcttactacaagacctcttgcatgtttggtatacactacaatggtcttgagtttttcatctttcaactcgtaaaaatcaaagtcaattactgtatggtttagcttttttctgtcgattacttttccgtactcattgctggcaagatgaagtaaaagctctccttttttcatttcggaattcagctgttctgtgatcttttctctccagaattcatacaggtttttgtattgctcaaattcaaatggacgtcccatttcaagcctgtacaacattactttatccgaaggtttcagtaaaccgtaaagcccggaaaggattctgtagtttttctgaaggtaatctaccgcatttttatccagtgttttggcatcaagccctctgtaaacttctcctgtaaaagcaaacatggccggagcagattcttttgcggtaggcttggatttccatttttgattcctttcccagttttcatcagccagcttagctgatatttccatcagttcggaaagatattttggtgatttttcttttaaataagattgtataaatgcagcgtcttcaatgaatttcggggtagtggttttcaacaggtccgttgaattttctacgttcatcaattttgccggagatgttataattttcataatgttaaaatacagataagtgtttaatgtcaataaaattcatccctgtcatcgctataaaatcaatcataaaatgacagataatcagaattttaatatttgaataacgtttgtaaaacaaagcaaagacaagtccgataaataaaggtccgataacctgggctatggtaccgtaagtgctatgcagaatcccgaataaaacagaggaaataataattcctgttgccggattgttataaattttttcaattctggactgtatataaccccgcatcaggagttcttctacaatagcagctgtaagtgatgtaaaagtaattaaaaaatagttgtttctgaaaataggtataagattcagaagtttatcacttactttttcttttataatgaacatactgaaggcattcagaatggctccgccgagtatacagagaaaatataagctcagaacagctttgatataaaaacctatggcatattttttctcttctttaagtaaaaaagaacttttctcaacaaaaatactgtatagaaatatgataatcaaaatgatccacaatattattctgctgaaaaaaaaatggtctgccgtaatttttcttatcccagtcattaaagtaatcgccggattagaataaagcatcgcagcagctaaaagaataaaagtaagtaaaatccctgcagcatatttcccggtaagactcatcattttgaattaaataattccttttccctgacggataatctccggttctcctgaagtaaggtcaacaatagtggatgctacattatctccatatcctgaatcaatcacaatgtctaccaggtgatcatatttttctgcaataagctcaggatcggtagaatattcaatgatttcatcatcatccttaatggaagttgaggcaatagggtgtccaagcttttcaacaataagttgcggaatcgggtgatcaggaacgcggatcccgatggttttatgacctttataggctaaaggcaaacttttattagcttccagaatgaaagtaaacggacctggaagatgacttttcaaaaatctgaaaaccgaagtgtcaataggccttgtaaagtcggaaagatggctgagatcattacagataatcgagaattttgacttctcaagcttcatttttttgagctgagccagtttttccatggctttgatatcaaaaatattacagcccaaagcataaaccgtatctgaaggataaatgatcagcccaccattgtttaatgttttaataacctcattcacaagattttcctgcgggttgtccgggtaaattttcaatatttttgccatagaacaaagatacaaataataaaatagtttttataaaagtcctttatttaaaagaaaaattaggaattttaaaaattattcgtacctttgcaatccaatatcgcgggatggagcagtaggtagctcgtcgggctcataacccgaaggtcatcggttcgagtccggttcccgctactaagtcagtgttttcggtaaacactctaaaaatacaccgcggggtggagcagtaggtagctcgtcgggctcataacccgaaggtcgcacgttcgagtcgtgtccccgctactaagtcagtgctttcggtaagcactctaaaaatacaccgcgggatggagcagtaggtagctcgtcgggctcataacccgaaggtcatcggttcgagtccggttcccgctactaagccagtgttttcggtaaacactctaaaaatacgccgcgggatggagcagtaggtagctcgtcgggctcataacccgaaggtcatcggttcgagtccggttcccgctactaagccagcgttgtcggtaaacgctcaaaaaatataccgcgggatggagcagtaggtagctcgtcgggctcataacccgaaggtcatcggttcgagtccggttcccgctactaaacgaaaaatcggtatgacgtattgttataccgattttttatgtttaaaatgatttaatgcaaagtgattttaatcaagaaaagtatttgtattttttaaacggtccgtcataattttagttttgtcattaccattagaatctataactttcaaattgccattatatattgatggattttcgtgaaaactttttcttgcttccaaaaactgtttcttacttttagctttaacctcattataataggttaatggctctataatttcgtctgatcttttaatctctgttgcatatatttcgatagttttatttttattgaacacctccaaaattaaacctgaaagtcctttgaatcggaatggtccatccggaatagcaatctcagtggtaaaccacgcaaaaaaagtatctcctgtatcagttatggttcttgccagctggcatttgaaaccttttatatgtttcatttcattcaaaatttcccaatctaatttaggctcctcaaacgaaaaaatatattttcctaccgggagatatgcatgaataatacctttagcattataaatactttctacggctttaggatatttcggaatgtttccataatttgtattgatagtttgtgtgaaatttcctttataatatgctttagcctctgcgctacaatagatggattctgtattattacatagtaaaacggatgaataaactttcactttttccttatttaggctatcggaaattatcttagtttcatagttaatttccataacagccttattttgtgccgagatcataagaaagcaggaaacaaacaatcccagaaatactattttcaccatgagtaataaagattaatgtttcacaataatatcaatttgatttgaacaatatgaatgaagaaccataatttctataaatttttaattcatccctggagctttctcttaacaattaattccttccattgttgatatgcctccctcatacaatgtccgcacggacggtaattattctgtaaagcatctttttcatctataaagaaaaccctgttttccttcttcatcctttttcctgaacggcaactgagcaatccgtaaatttttaattgtttattacctccaaaacagatttccctactgtggattttgcttctgagatcttcggttgatatctgagaatgttgaatcatagtcataattttaaaaactaattgactgcatcatgaaaaataatacccaaagcatagcggtttccttctttaacttcacttacgccatgtttcatattaactctgtaatggccttttgtgcctttttccggcttaaactgagtcgtgaaaataagaacgtctccttttttaggctttaaaacgatggctttagactgtgctctcggaatttgctgggtaagcacaaactcacctcctgtaaaatcttcgtcaggttcgctaagcattaatacgatctgaatagggaaataaatatctccatataaatcctgatgcagcgtattaaatccaccttttccatatttcagaattaaaacagtagccttttgctgaccgttggcatgacattgatccagaaattcctgatgctgcaaaggaaattgggtatcaatatgcaatgctttaaaccatgtgttggcaattgatgccagataaggatatatagttgttcttatggtctgaattatctctggtaacggataattaaaatacttatattccccgaggccgaaacggtgtctggccataacaactgttttgcggtaaagagcagaatggtcataattggattttaatgtttcgcaatcatcttcagataataacccgggaataatagcatatccgttttgatgcattgtttccgtaagttgctgccagtctgtactttttattttatgaacaatatctttcattggtttgatttgcctgcaaaaatctgacgttgttcagaatgatacaatccaaaacatgcggtatttaaatatcaataaataaaacggatgatatctggcctataggtttaatatatttctggatggtaccatcattcctgtttaaggctacttttgccatgtaataaaaaaaaatgaataacaatgaattacactattaaaaaggcaggtcttgaggatcttgatgaaacggctgaattgttcaatctttaccgagttttttacagacaggaatccgatgttgaaaaaggaaaaacttttctcaaggaacggtttttaaacagtgagtcggatatttttcttgcaatagcagatggaaaagcagtaggatttgtacagctttataagttattccattatacaaaactgcaaaagcaatggttactaagcgatctgtttgttcatcctgattacagaggaaaaggaatttctgtagcattaatagatcgtagtaagcaatggtgtgaagaaacaggagcatgcggattaatgcttgaaacagaaaagaccaataatatcggaaacgcattatacccgcgttgcggatttgagtatgacgatatgcacaattactaccactggtggaaacagggaaagtagtattacttctacaatgttgaacgtttaattctacaggtattgttctgccaatacaggacgtagacctatttttgtaaagctcttacagatcatgggtaggacagttgatctgtagagtgtatgcaaaaaaatctctgcctaattttctactttttccccaagggttttatgattagtaccacaaaactacttttccggtagagattttttgcttttaaaaaaaatagaaccgcaattgcagttctatttttttatttataggtgacttcagatattattgagccagttgggcgtaaggggtaagcttgttgtcatcagacatcgtctgtcccagaaagtctcttttctgatcagccttcattcttcccgcagcttcattggcattgaaataagcttcactcagttttgtagcgatatcagctggcttaaaatcaaatttggtatcaccatctacgcctaaatatccgttctttcttgttaggttagtaatgtaattattatagttgatcatggtacctctaaacatattgttatggtattccatgcattttttagcttttttagaagagttattcaggatgcagtttttcatattatttctatataagaaccattcagattctacaatagcgtattctttacctaaagtaatctttccgttgttcacaatattctgatctccctctttggttgcaatcgtctgaagatgttgaataaccaatggaacggtagcttcgatttttgatttagtatcttttagtatgctaaggtcggcagcaggagaaccctttttttgtgctgtagtaatgttaaaaataagcagtaatagtacaatcaataaattatatcttttcatgagaaatttttaaagcactaaaataaatataatttcccggttaaaacaaattcattttaattttatttaataaaaattaacaagttttaagaatttatcctttaaatgcttctttttatattaattagagaggtatatttttcactccgttaaaaaattaatatattttaactatttttatttgattgatttacagttagttattgtttttatttatttatcactaaaaaaatagttgtttgattcaattttatttctacatttgtataactaatttcttagtgatatagaattaaacggttttatatcacaataattgataaatgaacaggatatgaaaattcagactttaacaaaagcagaagaacaggtaatgcagtatttatggaaaatagaaaaaggatttcttaaagatgttctcgatctttttccggagccaaagccgcataccaatacagtctctactattttaaaagtattgaaggacaaagagtttgtagactatcgtgtacatgggagacagcatgagtattttccgcttgtttcaaaagaacagtattccgggaaaaccatgaaaagccttgtgaaaaattattttaaaggttcttacaaaagtgccgtttcatttttggtagaaaaaaatgaaatgacggtggaagaccttgaaatgctattggatgaactcaaaaagaaagactaatacctatggaagcaatacttttatactttggaaaaattattttatgttcgggtgtaacgtttttgtactaccagttgtctttaaaggacaagacattccatcattataacagattttatctgttggcggcgattgtgatctcgctgttattaccacttataaaggtagatgattttacgatcgaggtaaatagtgatatgtatatgcttcttgacaggatacagaattttaatacagaaaaaactatagacaatggtaacctttattttaaccttactttttcagctctgggactggtttctctctattttctagggaagcttatctatgggatttttaaaatccagcagtttaaaaaacagtttcagaaagaaagctttgacgggatcaacttttaccgtacagatcttaatgaagccccgttttcctactttaaaaatcttttctggaagaatgctattaccctgcattctgatattggaaaacagattttaaagcatgagatggtacatattgagcagaaacactcttttgataagatttttatcgagattataacttctgttttctggttcaatccgttctttcatatcatcaaaaaagaaattaaccttatccacgaatacctggctgataaaaaagccgtaaaacaatcggacaccaaagcatttgcgcagatgcttttagcaagccacttttccggaacacagttgcctgctgccagtccgtttctaagttcaaaccttaaaaaaagacttaagatgttacaaaaaccaaaaaccaagttcggatatgcgcgaagaatctttgcattaccggttttattctcagtagcctttgcttacctggtaaatgcgaaaaacagagaaattgaggaaaccaatatcagcattcagaaagcggtttcacaaattaagaaagacactgtaagacctgaaaaaatacagcaggaagaagttacagatccaataccggaattacctaaattaaaagcgaaatcagcggaacttcaaaaagaacttaatcaaaaaagtaaagaattaagtaagttgaaacctgaaacgtcagcttttgataaaaaaatagaagaaattaatcttcttgcttcagaaatggggaaaataggagatgaaacatcaagactggttgatcaatatttcaaatctccggaatggaaaaataaaatgctggccctggatcatatgaaagtagaattgccggaattgtccaacctcgatattgatgtagattttccggacccacctgtaccaccggatgcgccgggaactccaaaagcaccgaaggctccaagagtattttattttaaaaataataacgctgttcacttcaaagatctgagcggtaaagaaaaggctgaaatccgtaaagcgatgaaagaagccagaagagcaatgaaggaaggtgaaaaagccagaatccagggtgagaaggcacaaattgaaggagacagagcgaggctagagggacaaaaagcctttctggaaggtgaccgtgcaagagcagaaggagctagagccagattagaaggggaaaaagcaagatcagaggcagaaaaagcaagatcagaggcagaaaaggcaagattagagggagaaaaagcaagagctgaaggagatagaatccgcaaagaacatataagaatacgaatagatggggataaaatcagaaaagaggttgaaagagcccgtgcagaagcagaaaaaagatcattcagctttaaagacgggacctttataaaagtgaccaacgcttcacctgatgttatcgtaatgaacgcagattttatcaaaaaagatggtaacggaaacatcgccatgaatggggtgaaaaacttcagaataagcggaaatgatgatgtgaaatacaaatattatattgacgggagggaagtttctaaggaggatgtaaattcattagataccggcaatatatcgaaagtcaatgtcaatactcagaaaaaaggagattttaaacaaggggaagtaagaattgaaacaaagaaataaagttccatcgggttttgtcagtttcagattggcaaagcctttttaattatatactatgaaaagtaaaattctattttttatgtttctgggagtgctcgtcagtgcacaggttaacaggtttttttatgaatataagtttattccggattccaataataaggaagatgtgaagacagaaatgatgatgctcgatatcgataaaaacggatcaagctattacagccgtgataaatttgtcgcagattccaccggaaaggcagaacttgaaaagcagctgaaagcaggtggcggaaacatcagtgtcaacagaagggaaaaaccgggacaggtttcttataaagtaactaaacaatatcctgattttaaaacttatcttttcagaagcatttctacagataagtataaaataaaagaagaccagaaaccggaatggaaaatactacctgagaaacaaaaagtaggggagtatcaggcgcagaaagccactaccagctttggagggagagaatggatagcctggtttacgacagatcttccttttcaggatggaccttatgttttctacggacttcccgggcttattgtcaaaattgaagacaccacaggatcccatattatgacaatgataggtaataaaacctttaatgctccggcttctgaatcggaaatgcaggttcctgatcatgtgagagtactgggaataggaggaaaagagcttgaagtaacaaaagatcagttcaaaaaggtatggaaagcatatgcaaatgatcctgccaaaaatatgagagaaatgctgatgaaaaacggagatggcaatactaaagtcagttttaaggtaagaaccggggacggcaaagaaatctcagatcctaatcaggtacttcgggaaatagaaaaaaatactaaagaagcccttaaaaaagataacaatccgattgagccggatctggtaaactaaaaatcattatattttctactataaacaggatagcatatatgttattctgttttttatttataaggttgtaggtgatgaatatcaattaagattattgttacaaatttcttacctttccatagttaacaccaacttaatatcttatgacagaaaaggaaaaatgtgcagccggacttttatataatgccaactatgatgaagagctgattcaggagcgtattgcctgtaaggatttatgccaggagtataatgccctgaaaaattcggacacggaaaagagatatcaattactcaaaagaattattggcagtataccagaaaatatctgcatagaacccgatttctggtgcgattacggatataatataaaagcaggaaaaaacttctatgccaatcataacctggttattttggattgtgccagagtagagtttggcgataatgtgtttatcggccccaactgcagtttctatactgcaggtcatccgctggatgcacagcaaaggaatgaaggtctggaatatgcacatccgataaaagtaggcgataatgtatggctgggtggaaatgtagttgtacttccgggtatttctattggaaataactcagtaataggagcaggaagtgttgtcacaaaaaatattcctgataatgtggtggccgtaggaaatccgtgtaggattgtaaaatcaattgtaaaagaaaactaaataattcttcaactaataatccatgaaaaaaataattattgcattcagtctgttgttggctcttgcagctaatgcccagaatcagagatttatttatgaatataaatacagtattgactctactgccaaagacaaacccgaaactgaaataatgtttctggacgttgtttccaaaggatccaagttttacagtaaagatgtttttgaatcagattcccttatgactgcatctatggaaaaacagttacaggctggaagtacagaaatcaatttttccggtatcaaatttaaaggcaagattccttatagtgtagaaaaaagctatcctgattattcggtgagcttttttaacaatttatctgcggatgaatatttggtgcaggatgaaagaaaacaggagtggaaaatccttccggaaaaagaaaaaataggaacatttaatgctcagaaagccgtttgtaatttcgcgggaagaaaatggacggcgtggtttacagcagatttgcccatccaggacggaccttataaattttcaggacttccgggattgattgtaaagatggaagatgcttcccgcacccattcatatgaattaaaaggaagtaaaaaacttccggccggatatgagtggaagagtaccaaagagaaagaaaggtttaatgcactggttaccataacggaagccaaataccggaaagcctttaaagaatatcttgcagatccgatgaaaagtgaaaaacaaatggtggctcagggaattgaaattcaggaaatagatgaatccgggaaattgattcctattgataaagcacaaaaagctaaagaaataaaaaagaagaatgatcttaaaaagcagaacaacatcctggaactggatctgctgaaataagattggacataaaaacaaaatcccggaacattgttccgggatttttatatctgaattaagagtcagtgattatgctaatttctgagaatctgcaacaaactgagccaatccgctgtctgttaacgggtgtttcaataagcttaagatcggaggaagtggagatgtaataacatctgctcctattttcgcacagtcgatgatgtgcattgagtgacggatagaagctgcaaggatttcagtttcgtacatatagttatcgaaaattaatctgatttcctggataaggttcagaccatctgtagaaatatcatccagccttccaaggaacggagatacataagtagctcctgcctttgctgccaaaagagcctgcccgggagagaagatcaatgtacagttggttttgattcctttgtcagaaaaatattttaaagctttgattccgtctttgatcatcggaatttttacaacgatattagggtgaatagcagccaattcgtctccttctttgatcatttcttcgtaggttgtagaaagaacttctgcagaaatatctccgtctacaagctcacagattgttttatagtggtttttgatggcttcagctccctgaattccttcttttgccattaatgaagggttggtggtaacaccatctaaaattccaagatctcttgcttccttaatttgctctaaattagctgtgtcaataaaaaatttcattttgataaatagatttattgatacaaatatagggaattaattgggttctgaggtatgaattttgagttacagggtccggatatgagttatagagtaggagcgtttgagcgtttgagaattttgagtttttaagagtaaagataggaaagaaaattttctattaatcttaaatcaaacagttaactttgcttctagcttctagcttctagcttctagcttctagcttctagcttctagcgtccagcttccagcctgatcgttttaaattatgaattatggaaaacaagagtttcaccgctacattggaaatcataggaattaacccttttgtatttgttccggaagaagtactgaacacgatttttgaaaaatcaggcagaaataaaagtcctatcccggtaaaaggaactgtgaacggaaaggaatttaaacaaaacctgatgaaatatctgggagaatggagattgtacgtgaacctcatcatgttgaaaaactctcccaaaagaatcggagaaattattgaagtcgtactggagtatgatgattctgacagaagtatttccattcatcctcaactggaaaaggcgattaaagaaagcagcctggcaacggaaaactttggaaagctgattccttcaagaaagcatgaactgataaggtatatcaataatttaaaaactgaagccagtattcagagaaatattgagaaaattattcgtcacttacatggagaaaccgatttttttggaaagaagattgaataaattaagtattcatcaatgataacaaaaatgccggaaactttccggcattttttattgtactaagaatttaatgttttgctaagtttcagagcatcctcgttggtcgggtcatactgaattgatttagcaatatgctccttagctttatttggatcagttttctgttctgagaaagcaagatagaaataggcatatgccagatttttcttattttgctctacctcttcaggttttactgttgcaatatacttttcataagcaatttttgcgttggcatcatctttagcagactgataggcataagcctggctgtaataagacggagcccagtccggtaataaaacagagatttttttccaggtgtcaatagcattcgtccagtctgatgcatcctggtaagctgctgccaatttagctaaagattctgtatcttttggattggcctcaacctgcttcttaagtccttcaatagttggatttgctgactggcttgttgtggccgtagtttccggttgagttgtttgtgcatttacaagacttacacttcctgctagtattaaacctaagaataggctattaattttactcattttcataatcttatattttaaagtcaaaatctaaaattcaataataattccacaaaaacttaaattttagaggctttaagtttttttagaaaatattaacgggattgatgttttttttaatttaatttttgattcgttcatctttgaggttatctttgtccttcatttttattaatactatataatttcgtcatatgaatatcatattagcctcaacatccacactttttggtggagaatatctggaatacctgaaagaagaattaatccaattgtataaagatattgacgaaatcgtgtttattccttttgcccgcccgggaggtatttcccatgacgattatactgcaaaagcgcgttctttctttgaaaccatcaatataaaagtaaaaggtctccacgaatttgaaaataaagcagaaggcctgaaccaggcaaaaggttattttacaggaggaggaaatacttttttactggttaaaacattacatgaagaaggattgatgtctgttctgaaagaaaatgtatcagcgggaaaagcttatctgggttgcagtgcgggaagtaatatcggaggtcagaatatgaaaactacgaatgatatgccgatcgtatatccgccaagctttgattgcatggggctggttcctttcaatatcaatccgcactatctggatcctaatccggatctgaagcataacggagaaaccagagaaacccgcatcagagaatttcttacccaaaatgacatcaaagtggtaggtctcagagaaggaaactggatcagacgaaccggagatttaataactgttgagggaagtgaactgacaaggatttttgaaaaaggaaaagagccttacgaaattgaagcaggaagcagactttaatgaacgaaaaagaaataaaccttttcatagaacgtaacctgactaatttttcggtgaacagcaccggatgggacggactgatccggaaattactgtatgaatttgcgatggctggctggaatcctgagcataacgtattgggaaaagaaaagtttggcggattgagatgctatacctattctgaagatgaagcgcttaataacaaacttaaaaaaatcaaagacaaatattcagaattgtctgttaaaacctgtgaaatctgtggcagtgaaggtaaaatgagaaccataggttcatggcagaccacattgtgccttactcatttcctggaacagcagccggttattgaaatcgataacaagcagaatatcaggagagaccgtaagaccattctgaatattaaaaatatcattaaagctgaggttgaatatgaccttcagagattatggctttataccaatcgggaggaagtagtttatttttcatggcaggaacccaattactatctgcttttaaaaacgattccgctttcgctttttcccgaagacagacgaggtgaaatttcagcattatttcaaagcttaaaggattgcgaaatatgtggttataaggctgttcatcaaaggaattgcctgcggtgtcataatgagccatggagtgaatccggattttttattcaggagtacaatgaaaaatcagactatattaaatattgccagatggatattttcatagatgaagatgattatgaaaaatattttcaatatgaccggtcatttgaaaaagatcctgatcaccagattcttttcacttcagatgatctcagggagtacgaaaagcttttattttaactatatttgattagaatttagacatgcgaaaaaggttcatgccttggaacattaataccattgcaatgagcttttgaatgctatttgtttagacctaaattaacaatgtaatgaaaaaaacacttgctgtactcacactttctgtacagatcgttgccgcacagaatatcgcccagaaactagacaaagccacaaaggatcttatggattcttcgggagcaatttcttccggcctgtcattttatgtttcggatgaaaacggcaatcttatttatgaatatcaggggaacaaaggtctttctacagcttctacacagaagatttttactgccggtgccgctctggaaactttaggtaaaaactacacctataccaccacctcaagttattccggaaatatatcagcaggaacgctgaacgggaatttatttatcagttccaatggtgatcctacattgggaagctggcggtatgagggctataaaccagaaaattttaaaaagaaactgatagatgccattaaaaattcagggataactaaaatatcgggtgacctcgtcattgatgattcttattttgaccatcagacgattccgggaggctggccgtgggatgatcttggaaattattatggcgccggtgtttggggaatcaactggaaagaaaaccagtttgatattaatattaacggaaccgattttaaaagcttttcttatcctttagaaggagtgaaatggctgaatgacctgaaaacaggaggaagctcagatcaaagcctgatctttaccgctcctcattctgatgttgcgctgattaacgggatgcttccatcagggaaaacagttacggtttccggttctactcctaatccgccgctacagctggcagcagaaataaagcaatggctgaaggaatcgggtattgagctttcgggaaaagcggtaacaaactcgcagcttgaaattgatggaaaacaggctttggaagctccgaaaaataatattattctcactcaccaatcgccgactctggataaaattgtatactggtttctgagaaaaagtatcaatctgtatggtgaaacattaattaaaactttaggaaaagagaaaaaaggaaattcaagcttcaaaagcggggtttcttatctgaaagaattctggaagtcaaagggaatcaacccaaatatgatcaactttgcagatggaagcggactttctccacaaaattatgtagctgcaaaagcagaagtgcaggctctgttatatgccagaaaacaatcctggtttgaagcatattatgaaggatttccggttcaggataatggaatgaagatgaaaagcggaaccatgagagataccaaatcttttgcaggatatcataccgcaaaggatggaaaaaaatatgtattttcgattattatcaataactatcagggaagcggaaatgcagagctgcagaaaatcctgaatgttttaaaataaatacctttgagaaaatctatcctcaccaggctgaataactggatcattttcgttgtgatgactactttggtaattgccatcatagtagcttcaacatcgcttattaattttctcagaaaagaggagatcaaaaggatcagtctgctttccaaagcgataaggatacagcaggaagtgaagactcctgatacggatgttctggatctgctgccggatatcctgaatatcaacaacacaattccgttcatcgtaacagataaatataaaaatccgattcttgatctcggatactacagaaatattcctgaaagtacaatcaaaaaccctgaaaaactacaggatctgatccggaatatggagaaaaattatgacccgattgagatcaaagtgccggatggaaataaccagtttgtgtattatgacaactcccgtttgctgaataacctcaggtattcaccttatatcttaggtctgtttattctgctgtatttcggtttttctttctggtttttcagaaccattaaaaagacggacgaagggtatctttgggcaggtctggcaaaagaaacagcgcatcagatcggaacacctctatcatccatgatcggctggatagaaattatgaagctggataatccggattctgaaggagtacatgagattgaaaaagatattgaaaggttgagaaccatctcagaacggttttcaaaaataggatccgttcctgaactgaacgacagggatttcagtaaaacaattcaggagaattatgattatttaaaaaccagaatttccagaaaaatcaattttaccctgaatcttcctacttataccgttttggtgccccacaataaaatcctgataagctgggtaattgaaaacctggtaaaaaatgctgtggatgcgatgaaaggagaaggtgctattacaatatctgtttttgaaagaaataagaatattttaattgaagtaaaagataacggaagcggaatgacaaaacaacaggcacgaaatgcttttaatcccggctattccaccaaaaaaagaggctggggactgggattgtcgctggccagaagagttattcatgaataccacaacggagatatcaagatttcccagacggaaataggaaagggaagtacctttagaataacgatcagaaaagaggagtgatgctggtttaatgagttgtaaacagaaaatcacttgtaaacagaaacctaacaggttttcaaaacctgttaggtttgaatgttaaagaataagaataaatatcagccttagaaaataaaaagcggggaaatttttccccgcttttctcttattttttaccagtgagccactgggtctgtaatttcagctcttccggagtaggattcgctttaaatactggggtttccatggtcattttatccagtattgcttttcctttcagcgtcattttctctttctttccggcattatctctcaggatagttacggtaacttcctgtccgtctttaatggttcgggtatacccgataaaatcctgtactttttttatgtctaccgttcttccatccagggcaagcacctggtcagtaattttaaatcctatactttttgcaaatggagacagtgcagaatgttcatcaaaagcaaaagcattggtcttgtcatcaaaacctgtctggttcggatctttgataaaccagaaaataggctggctttcctgttttttaatatctacacctaccatgctcagatattgtgcataaggtgttggctggttccctgcaatatatttgttgtaaaattcttttacctgagggtatccggttacggttaccagttcatcaatcagcttatcatctttgaaaggcttgttttcaccaaatctctgtgacagttttctgatcatatcacggtagcccatttctccgttggaaagctttctgagctcaatgtctaaacacattgctaaaagtgctcctttctcatacacatttctgtactgatctttgtaaggctctaccaatacatttttactcattaccgtaaatggcattgtatcatcatagcttttggagttggcgattttctcaccaattctttgcaggaactggtttttgtcgatcaaaccttcctggatctggaataaattggcaaagtattccgttccgccttcatacatccataagtgctgtgacattttaggatccgcgtagtcaaaatagtggatttcttcagaatgggttttcagagggtttaccgtatggaaaaactcgtgagaaaccacatcagtaatggtgttgtcgattgcatctttaggcatggcctcaggaagcacaacgcttgtggattcatggtgctctagtgctccgaaaccttttaccgacggaccatcacctccggaaagataaagcatgatcgcatactttttattcgtattcatatctcccaggaatttcttctgggcaataaccattttttcaagattgtctttgaaatcagcggctttgtattttcctgtcggggaatatacacccaaaacaagatccatccctccggcattgaaagtgatataatccggctttgtatacataagcggagaatctgtcaccttcgcataattggcaagggtataggtatctgtagattcagatttatcctgatctaccaacgctgtggttccgtagaaatcggttggtttctgaacgatcagctgatacggaacatcctgcatattctcaatatatccaatgaatccgtgggtattgatcatatatacttttcctgcctcaatatcggtccctgacggagaaaatacagctttatgtttggaggtatccgtttcttcatcaaaactatcattgacaagataagagattttggaaagtccctgggcatttttcaatgaataggtattgtcatttactttggtatacgtaagttcttttcctttattatcgtaaaatttaattccttcgatgaatcttccgtagtcgtctacagaataagtacccggaactgtttttgggaaatgaaatttaacatctccggatttcattttcgggaattccatggtaacggctactttatcatcttttacattaacaaggtcaatggttgttttaatagactgggcatttgccaaaaaagcagcaaaaataccgaggctaagtactgtttttctcattaggtttacattaatagttaaatagttgctttttttatcaatttgttacggaaaaagtattaaacttttcttaaaattttaaagaaaaacgaaaaaggcaaatctgctggtatgcggatttgccttttttctttatttggtattagaataattgatataatagttgggattaaactcaaccggactattgtttttaagctttacggtctgccattcttccgttggatttatggtttgatctccattaatgatgataggtaatttcagattttttaccacatctgtataacggaactttaaagtatcgccatcctgagtatattccagagttgggatctttactgttctcagatactgatcaaataccgttgaaaaatcaattcctgattttgaggagatataattttcaatctgttgagtggtaaccgtctgatgataaaaatctttattcaggcctcttaaaatctgtctgaatttttcatcattattgatgacctgccgtatcgtatgaagcatattggcacctttcggatacatatctccgctgccttcatttcttacgccatactggccaataattgggatgtcattgtctatcagtttcctgatcccctgaacatagatgtcagcagattttttgtccatatatttttccgtgaacagggtctcggaataattggtgaaactttcatggatccacatatcagcctggtcttttgcggtaatattattagcgaaccattcgtggccgctttcgtgaattataatgaaatcccagtttaatccaactcctgtacctgaaagatctctgccaagatagccgttctgatatttgtttccataggctacattactctgatgttccatgcccaggtgaggagactctacaagtttgtatgaatcttcataaaacgggtagggaccaaaccagtactcaaatgcggagagcataggctttacctgttgaaactgtttttttgccttatccaggttatagtcaagtacccagtaatccaggtccagttttcccttttctccctcaaatacatctttgaaatttacatattttcctatactcgggataatggagtaggcattgataggattttttacttcccaggtataagtagttttgctgcccgttgtttttttagtaatgagcctgccattacccacacccaccagatcattaggagttataattttcatgatgattccgttatcaggttcatcactccagatatctttggtaggaagccatatggaagctcctattccctcatcagcagctgtcatccatgggtttcctttttcatctttagtaaaaacccatccgccatcccagggtgcctttttagcaatggttggatttcccgaatagataacgttgatcgtgtatttttccccttttttgaattttttattcgttgtaatgaaaataaaatctccatcctgtttataattggcaataggaaaacttgcttccaccttatcagctttcataggctgctgaaggtcaatctgaaaaacaggattggtaacatcttttataatctcaaagctgattgtattatttcctttgatgcttttctgttcaaaatccggttctacagaaagatcatattttttgacatcccaaaaattccggaattccgtattggaaccttttaaagtatcctgtttggtaaaaaccttccctttctcaaagaactgtccgaaaaccaatcctgatgcaaataacagggtgtatgacaattttttcatttaaactttattaataatcttttcaaaagtataaaattaaattaatagccttacgcagaaaatcaaattaaatacagattttaagaagacatgaaaaagcccggccattaatggtcgggctgtaaaaaaacaagttagttttattttttgatgaatttcaggttggtagtagcacctttatcttcaattgaaatgatatacgctcctgtacttaattttgaaacagaaattttattatcattaatctggccgttcattactttctggcctgccatattggtaataataaactgagctttggatgaaatctgagttacatttaatacatcacttaccgggttaggatagatctgaatagagctcttatctttcactgtctcacttgtggaaagctgctgctggataagtaccggataatcttcaacttcaccatactgctggttgctgcatccgctgcttggctggctttcatatcccaataccactctcataataacgtttcctccggtataagcatctgcaggtacagagaatgttccggaaaccggtgttgctatgtttggtgcacttgtataaatgacttcagatgaagagaatactccgtctttgttgaagtctatccatgctgttactccgtcattatattgtgcgcctgtccatgctttggtaatgcttatattgttccctgaagatccggacataagagtgatcagcttcgaagggtcggaagtataatccgagtaaggagtattgctgctgctgtttgaaacagggttcattcccgaaggcgttaccgttacattagaaatatattcgtcagctgcgtttgttcctgttattgaacatctggcaaatgaagacgttgtaaaattggttgatgctgaataagaacccagcgtacctgcgcacacattagccacctgtacttcatattgagttgattcagtaagtcctgaaatagtatatgagttcgttgaaactggaacagtggtccaagtggcagttcccacttttctatattgtatagaataggatgcacctaccagagctgcccagtttacagatgccgaagttctagtaattcctgttacagtaattccggtaggggcagatgttgtacaggcacttgcagatgcggaaacagtagcatttccaatcgcatagaatacattatcaatagcacttactcttatttttacactggcacctgttgccagagaagagaatgaaaacggttcagcaccatcattcggagtagatggggtaattaccgtccatgtgctcccattgtctgtggtataatctattttaacattctgtacattatacggagcgctattcgtgtttaccacatcccatgtaatcgctcccggtgtattattataaacagtagctgatgttactttaaacgggccttcgtttcctatatccactttcatcaggctgctctgtgtctgctgttgtgcagcatcgggattattatctcttaccgttaccttgaaattcattgttcttgggatgttggataccgtttcccaatctgcagcactggtaagcgtgccattaagaacatttgaaaacttagggaaatagcgtgtcggattggtggttggcatcagagatctgaagttggccccattatttctggtagcactcaccggtccgaaagcagaagttgccagatcatattgctcccaggtatatgtcatcggatcattttgggtgtctgttgcagaagcggttaacacaaaagctgttcctttagggatcattttactggccattggctggattgaaggtggagtattggctaccggagtaataataccacaatcctgagaattgacatacgctccaacttcctcaatatttttagtatgaaaataagcatcagaatgcatctgaacattataattggtaatgccggcgtatcccattatagtagatccggatccgggctccatatgggcaccatgcaaagcaatagacattgtatgggcggcaccaaactggtggccgatttcatgagctacaaagtctatgtcataattatctccgaaaggctgatccggtgtggaaggtgaagtgattcccgcaccttttgaagtagcatcgttattgcttgcagggtttctgcagacatttcctacatccccggcacttccaccgccgcctctgtggccaaagaaatgtcctatatcatacgcattattacccacacccggtgtattggtaagagtttgctgaagctgaagattccatgctgcgggagcactatatgtaccatttgtattggttattacattcgaataaggatccgtagcaggatctggaaatatgagctgaggaagatcctgaacaatcatatggattccaaagtctttttcgaacacaccatttacacggttcattgttgcattaatacgtgccgctgccaaaggaacgcttccggcaagctgtgtatattcaccgtttacggagatggcgattctataggttctgtacttttgttcactgcttttattaaaacctccgctattcaaaacactttttgtcttaagcagcttattcatctctttttttgctttctcaggctcagaagttctgcattcgaaagggtcttcatgagatttattggatttgaaaaagactccgtaaacatctttttctttgttgatgggttctatgaattcgtattttcctgtatcggcatcaaataccatggactggaagtcattaggtgcagtactgaaccggattcgtttatgcgggttgtccaggccaataccggaataggctcccaattcatagcggtctgccatagacttttctactacaggcgagctgtatactgaaaatctttcaatttttccattggctgctggaataaaaacaattaccgggtttcctcccgtaccggcttcaggagcatttttcagctgatttctcaatgcagaaaggtcaaacttataggcatattctacctttacttctttccttaccggtgccactttccccgaaaccggttcccagcgttgtgcctgtaaaccgctcagacctaaggccaatgcacagacgagaataattttctttttcatattatttttgattgtaattaacgttttaaatatagtgtattttttttaatattttgttgataattcagtgttaattgtctataaattgataatattagttaaattttgcaattgttttaaattgaattaagaataaatataattaaggttaatatttttatataaaaaagcgctgctattcatacgaatagtagcgcctgtattttttttagtaaaatattaattattcttgtactgccggaagatttccattgcttttctgaacctttttataagtgaacgtacacatcataatactgaattcatacaagattagcagcgggaaggcagccatcagcatactcaaaacgtcagcaggggtaataattgcagcaactaccataatcagaacaatagcgtgacgacggtaagttttcatgaacacaggtgtaaggattccgatgcttgtaaggaaatagatcaggattgggaaaaggaatatcactcccatacccaaaactacctgtaaaaacaaagtggtataatcacttaagtcataaagcggaacgataatatccgaaattttaaaaataaccccaaaattaacagcaaacggaaggattagaaaataaccgcataataccccggtcatgaaaagcatccatactgcattgatgatataaatggaattctttttttctctcgggtgtaaagccggactgataaagcgccacagctcccatacaatataaggaaacgcagccaccatcccgccgaaaaccgatacagccatcattacattgaactgctgatacagcctctgcacgcggacagggaaatcttttggaagatgaatgctatcttcgcccaaaatcattcttgaaaaatgattaacaagcctgaaggtagggaaatcatttctggtaggcccaaaaaagatatggtccataatccagttgatgttaaagcccactacaaatgcagcaactatgatagcaataatcgaacggatcaggtgtcctcttaattctcctatatgtccaagaaaggacatgtctttaccttcgctcacggaataaaatttttaaagggcaaatttataaaaaaaatgacagaagtgaatctgatttctcagttctaattgattccttcatccagcagtttatgcagatcaataatcccgaaatattttccgttttctgtaacaaccagctgaccgatattattttctttcagtattttcattgcttctttagccaaagcatctttttcaatggttctcggatgggcagacatgatgtctttagccagcaccttgctgatgtcttcgcctttcatcagcattcttctcagatctccgtccgtgatcaccccaataatctggtcttcattggtgactacggtaattccatggcttgatgcactgatggaaataatgacatctcttatcggagaatcttcagtaacctggggtttttgtgaagataaaaactgctcaactttagaagtcaggttttttcctaaacttcctcccggatggaattttgcaaaatcattagctttgaaatcgttcagttccattaaagcaacagccaaagcatctcctaatgccatttgtatagtggtagaactggtaggtgcaagtttattgggacatgcttcaatatcaacatgagtatccagaattacctctgaaaattccgccagtttgctggtcttgtttccggtcattccgatcaaagcagaagaataatcttttaaataaggaaccagattggcaatttcaggcgaatttcccgaattggagatacataaaaccacatcctgtttctgaattactccaagatctccatgaatagcttcggaagcatgcaaaaactgagaaggggttcctgtagaatttaaagtagctacaattttattcccgacatgagcagatttccctattcctactacaataagtttcccatttgctgaatgaattatctctaccgcacgggcaaactggtcattaattctgttttttaatttttccagttcggaaatctctatttctaaagtgctttttgcaattgatataatgttggttctatccattttacgatgataaggtatacaaaaaagttcttaaaaaacgttatattttaaaaagaatatttaatataaattttattttttataaattcgttcgcttttattttaagcagaatttttataactttgggtgagatgcaaatttagcaatagaaaattagatgagcgcaaaaaaagccaatttatcaggcgaattgaaaaagtattttgggttttctacatttaagggccagcaggaacagattatagacaacctattaggagggaaggatatatttgttttaatgcctacaggtggcggaaaatcattatgttaccagcttccggcacttatttctgaaggtacagcaatagtagtttcgcccttaatagcgttgatgaaaaatcaggtagatgcagtaaacggcctttcatctgatgatggggtagcccatgtactgaattcatcattaaacaaaacacagaccaaacaggtttttgacgatataaaaagcggcaagaccaaacttctgtatgtagctcctgaatcattaattaaagatgattacctggattttttgaaggaagtgaaaatttctttctttgctatcgatgaggcccactgtatttcagaatgggggcatgatttcagaccggaatacaggaatctgaaacagattatagacaaaattgccaatgtaccggtaattgctttgacggctaccgccactcctaaggttcaggatgatatccagaaaactttgggaatgaccaatgcattggtatttaaagaaagcttcaacagacctaatctatactacgaagtacgtccgaaagttaatgtagataaggaaatcgttaagtttatcaatcagcataaaggaaaatcaggaattgtatactgcctgagccgaagaaaagttgaagagtttgcccagcttctgcaggtaaacggaatcaatgcacttccataccacgcaggtcttgaccaaaaggtaagggtggcaaatcaggataaattcctgatggaagaggtggatgtaattgtggcgaccattgctttcggaatgggaattgataaaccggatgttcgttttgtgatccattatgattttccgaaatcactggaaagttattaccaggaaaccggaagagcaggaagagacggaggcgaaggtcactgtctggcattctatgatccgaaggatatcgaaaaactggaaaaattcctggctcagaagcccgtgtctgagagagaaatcggattacagcttctgaatgaagtagtaggctatgctgaaacttcaatgagcagaagacaatatatcctgtattattttggagaaagttttgacccggtaaagggtgaaggtgccaggatgtgtgacaactcatccaacccgccaaaattaaaagatgcaactgccgatttgaaaaaagcgctggagctgattcatgatacaggagaaaaatttaaggcgaaagaccttatttctgttatcgcagggaaggaaactgcggtaacaaaatcttacaagcttgagcaaagttcttattttggcttcggaaaagaagaaaaagacaattactggaaaacgattttgagacaggccactgttcagaattttttacagaaagatattgaaacatatggtgttttaaagattactgacaaaggaagaaatgttctgaatggtaaatctaaagatgtctttttaattgcagaagacagagaatttgatcttacccaggcaaaagcagaaagtgatcaggtacaacagcaggccggaggaggtctggatcagaatcttttcaacctgttgaaagaattgagaaagaaagtggccaaaaagcacggaatcccgccttatacggtgtttatggatccaagtttggaagatatgacggttcagtatccgatcacagtagatgaaattaccaaaatctacggagtaggggaaggaaaggccaaaaaatacggtaaagaattcgcagattatatcaaaacatacgttgaggacaacaatatagaacgtactcaggacatggtattgaagcaggtggccaataaatcaagtcacaaagtattcattatccagagcacggataaaaagattgatcttgaagatattgcaagagccaaaaacctttctatggatgaactcctgaaagaaatggaaaggatcgtgtatcagggaaccaagctgaatatcgattactatattgaagacaattttgatgaagatattgtagatggtttcatggaattcatgaatgaatctgaaagtgacagcatgaaagtattgctggatgaattcggggatgagctttctgatgaagaagtgagaatgttgagaattaagtttatcagtgacgtcgcgaattaaaaaacattataattaaaatataaaataagctcttcatctgaagagcttattttattataagttcgtttaaacttttaattcatagttaatttctgttaacaatcatcccaaacggtcatcttcatccttccaatatttgaaagataactaaactttttagtaactttgataagatgaaaaaaatatctgtcatatttattctgccggacttagaaaccgggggcgcagaaaggattgtaaccaccattgcaaaccatctttcccgagatcggtttgagcctaagattttgttgttacgtaaacagggcggatatttgaatttcctcaaaaaagatgtcgaaattattgatatcaatactgaaagaataagacattcattaagacctattttgggagagatctacagaagaaaaccggatattgttttctcgggttttggcgaagtaaatgcctacctgtctctatttatcaaactatttccgagaacgaaattcattgcaagggaaactaatgttgtgactcagcacgttacccgtaaagaaattaaatttttctacaacttctataataattatcagaaaatcattgcccagagcgatgacatgctcaaagatcttgttgataattttaatattaaaaagaaaaagattgttaagatcaataatcctgtagactttgatttcattgaagagaaaatggctttgtcttcaaaaccagagtgtttcaaatacaattataagaatgtggttgccattggtaatctatcttccagaaaaggatttgataatcttcttaaggttttttcaagacttaaaaatgaaaacatcatgcttcatattttaggtgacggaaaagataaagaccttctgcttcagacaaaagaacttttgggactgaaaaaagtgatcttccatggaaggcaggataatccttaccaatacttaaaatttgctgatttatttgttctttcgtcaagatatgaaggttttcccaacgttcttctggaggcaggtgcctgcggaacttattccctggccaataattgtcccggaggaattaatgagattatccagcataatatcaacggagaaattgcagatattgaaaaccatgaccgatttgcacaggagattgtgaggattcttcagagcaattataatcgggatgctattaaaaactcgatcaaatcaaggttttcaaagaatattatactggacaaatatgaaaaagtattactggatttaatgaagtagctcctattgtctatttgacttatggtgttttatttctttaaatttggggctaaaataaatcgtaatgaataaaatcccgaaaataggatgtgcctgtgaaaaacctgatttcaattatacagaattcagaagttcggaattaggtatagatcatactaacggaagatatggagaagtaacgattcagcagtgcaagctgtgccagagaatatgggttcattattttgtggaatatgagcattattccaaatcaggaagatggtacaaaggaattgtttcgaaaaaagaccggccaaatatcactcctgaaaatgcagtggagtatctggaaagccttgaatggtatgtgtatggaggttcgttttttgaaagtacaggaactatcgggcaaggaacgctgaacgtataatcttctatgctgatttattaacattaaatatcacatccatgaagccatttataattgctgctgtaatgcttaattctgttgtaatgatagctcagcagaagacaatctccagaaaagagctgttaaaaaccggtattgatcagaaagtaaaatctacggagattcaggaaataacaatggctgcagggcagggcgctcccgaacatctgcacccttgtcccgttttagggataatcagttccggcgaagctgtttttcagatagaaggacaggagaaagtagtacttcataagggagatgctttttatgagcctaaaaatgtgaaaattcttcattttgataatgcgtcagctgaacaaccacttgtctttaccgccatttatctgaaggagggaagtgaggaaaatataaagttcataaaataatacttttcatcaaactaaagcatataattatcatttttaaaattgataaaactcactttggtgcttggtaatttatatgtaaatttgtgagaattaagatagataataataaacaaattcatacaataacatgagtcaattcgatgttaccgtaataggttccggtcccggtggttatgttgcagcgatccgtgcagcacaattaggtttcaaaacagcaattattgaaaaatattcaactttaggcggaacttgtcttaacgttggatgtattccgtcaaaagcgcttcttgacagctctgagcatttcgaaaatgcaaaacataattttgcaggtcacggaattatcatcaacgagccgcaagcggatatcgccagaatgatcgaacgtaaaaacgaagtgatcaagcaaaatacagacggaatcagctatctgatgaacaaaaatcagattactgtttttgaaggagtaggaagcttcgaatctgctactcagattaaagtaactaaaaacgatggttcttccgaaacaatcgaatctaaatataccatcattgcaacaggttctaaaccttctacattgcctttcattactttagacaaagaaagagtgattacttctacggaagctttaaaccttaaagaaattcctaagcatttagtagtaatcggtggtggagttatcggtcttgaactaggttcagtatacctgagattaggagcacaggtaacagttgttgaatttatggataaaatcatccctggaatggatggagctttaagtaaggaattgactaaagttcttaaaaaacaaggaatgaagtttatgctttctactgcggtttctgcggtggaaagaaacggagatactgtaaaaatcacagctaaagataaaaaaggagaagaagtagttgtagaaggagattactgtttggtttctgtaggtagaaaaccttacacagacggtcttggacttgaaaaagcaggtgttgagcttgatgagagaggaagagttaaagtaaatgatcacttacagactaacgtagctaatatctatgcgataggtgacgttatcaaaggtgcgatgttggctcacaaagctgaagaagagggagttttcgttgctgaaacattggcaggacaaaaacctcacatcaattataacctgatccctggtgttgtttacacatggccggaagttgcaggagttggtaaaactgaagagcagctgaaagaagaaggtgtagcttataaagtaggatctttcccgatgagagctttaggcagaagccgtgcaagtggtgatatcgacggtctggttaagattattgcagacgaaaaaactgatgaggttttaggaatgcacattgtaggagcaagagcggctgaccttattgctgaaggagtaattgcaatggaattccgtgcaagtgctgaagacatcgcaagaagttctcacgctcacccaacctatgcagaagctattaaagaagctgcattggatgctactgcaaaaagaccaatccatatgtaataattgattaaagatttaatcatttaaatataaaaaggagaaatcaattcggtttctccttttttttgtataaaaatcgaattagtttttaaaatttcatctattaattataataacggtttttacattattttcatcttatcataaaacttagaatacttaggtgcaatattgagctgtattccaaaagtcactcctttaaaatatttttctttatgaattggaaaggcatagccggtatttaaaaagatggtattgaataatgaaataccaattcttggctccaatgaatactgatttcctgatatcccaaaaagtaatccgttatcgataaaattaatattagcttccggaatgaatttatcggtctggttaatgcgggtatagagaagagaaggaccaactactattgatttgtaacggctttctccaaatctgtattctaaccctgcctgcaggacgtttcttccggtgtaacggtatgaaatattcaatgcagttttctctaaaatctgggcttttacaaaaaacattgaaaaaaacagaaacagtataccatattttttcatgattatttttgttcaaatgtaagcgtttttatggtatttatgaaagatgtaaatgaggcttcaagaattataatcgtattgactaggttcgcatcttcaaatttccgtaactttgtcagctaattttatcatcaatgcaactcggaaaaactcagactttaacaatttcagaaaaaattaattcaggatggatcctcgtagacgaatccggtgagaaagcttttcttcctaaaattttcattcaggatgaaaaagatacaggtgatgaagttgaagtatttgtgtatcaggatgacgataaattaaaggcaactactgaaattccattggctgaagtaggagaatttgcggtaatgagctgtgtacaaagtcttccaagcggagcttttatggattggggaatcattaaagacttatttattccttacaagcagcagaaaacaaagatcgtagaaggaaaaagatatctggtatatatctatgtagatgaagatatggagctgattaccggaactacaaaattcaaaagaaatcctcagtatgatgaacttccgttcaaaaagggggataaggtagatctgatcatgatgaacgaaagtgaactgggctggaatgtgatcatcaataagcaatacattggccttatctatgcttcagatgtttttaaaaagctgtatccgctgtcagaagaaaaaggatatatcaaaacaatacgtgaggacggaaaaattgatgtttctttacagccggaaggttttgaaaatattgacgagttcaagcagaaaattctgaacaagctggaagaaaattacggacttctgtatgtttccgacaaatcttctcctgaagagatcaaagatgagcttcagatgagtaagaaaaactttaagaaggcgatcggaggactttacaaagataagattattgatattttagacgataaaatcaaattattataaaactaaaaacgggcagaaatttctgcccgttttttttattacctgctgtaaaaaaactaaattattttattgtacaccttggatttagattaataacatgacggatgtcatgacttttttgtttaatttttttgtttaacagttttgtcaaaaataaattttactataaatttgcacaaatttgtttaacaaaaatgtcaaatcaagcaaaaaaagaccaaacacaggaattgatcaaggagacagcgaaaaatttgttctttgtgaaaggaaaatttgatgctactacgcaggagatcgcagatgaagcaggagtgaacaggacccttattaattactatttccgttccagggataagcttattcagatcatctttgatgaagcacaaagagtggaacaggaaaagtcgaagatcattcagaattctgatctgccctttaaagaaaagatcagcaaattcattgaaagcagcctttctacaagccttcagtatccgtatcttgaaacgtatatcgtatcccagattaataaaggaacctgccatcacagggaaattgaggaagatatcctgaacgaaatgtatcgtgatattgaaaaggaaatggagttgggaaatattgaaaaaatggcaccggtgcagtttattctgaatatggtttcgctgctggtatttccaagtgccatacgaccgttatttatggagaatcttttaattaatgatgaagaatatgataggattatttctgaacgaaaagaaataattatcaatatgttatttaaaaattaataaaaactaaagtatttctgatgatgattcgtcaaatagaaataaataatgaacgaattaaataaaaaaataaacgaagtataaaattatgaatagaaaacgtataactgctacaaagctaaaaattgggatagcttcagcatttatgattttcggtttttcattggtgtctgcccagcagcaggtttccctgcaggaagcaatcaaacaggccctccagaataaggcagaagcaaagaaagctgctttacaggttaaaaaagccgaatacaagattgatgaggccagagccggggctctccctcagatcagtgcaacaataaacaatacgtacaatcctattttgcaaaaatctgttcttcccggtgaggttttaggtaaacctggtgagctgattcctgttgcctttggaacgaaatggcaatctgtaaacgtagtaactcttaatcagaacgtttttgatcagagagtttttattggtcttaaagcagcaaaatctacaagagagttctatcttttaaattcggatttaaccaacgagcagattattgagaatgttgccacagcatattatcaggtgttcgtacaggaagagaatcttaaaacggtggaagagagttatgccaatacggaaagggtaagaaacgttatcaaaagtttggtagataatggtcttgctaagccaattgacctggatcgtaccaatgttcagcttaccaatatcggttcaaacaagcagcaattaattaatgctgttgaagtgtcaaaaaactcattgaagttctatatgggaattcctattgatacacctattgaacttgaagacaaaacaattgtaccgaatccgcagctattggacagcaatgtaaacctggagacgcgttctgaattaaaagttttaaataaacaaagagagcttctggaatatagcaaaaaggcaactattgcaaatctttatcctacggtaggactttcagctaactatggctggcagggactggggaataaatttccttatgctacgggatcaagccagggaacgaactggggagactatgcttccattggtttagcgattaaaattccgatttttatgggaggggctaccaaagctcagattcaacaggcggaaatcgatattcaggatctggatcaggatatacagaaccaaaaactgaacttgagtttagattataaaaatgcagtttccaatatggagaatgcaataatcaatattcaaagcatgaaagataatgtggacctggcagaaaaagtacagaaaaatactcagtccaactatcagtatggtttagcaacacttacagaagtattggatactgaaaatgctctgacgcaggctaaacagaattatgcaaatgcattactggactataagcaggctgaaatcaaagtcattaaagcaaaaggagagttaaacacattacaaaacccataataaacaatgaaaaaaactttaatatatatcatcgtagcagctgtactggtaggtttggccgcttataagattgcaggtaacaaagaaaagcagactcaggaagtaaaagaagttgccaagcaggtagataaaatcaacgttaatattgtaaccgttacaagagaaaatattgatacagactattcagccaacggaactttcattcctaagcaggaaatgaaccagtcttcggagatctcaggacgtatcgtaaacgttttggtaaaagaaggttcaagagtaggtgcaggccaggttctggcaaccatcaaaagagatgctatcgaagtggatgttacccaggctcagaataacttgcagaatgctattattgataaccagcgctatgaaaacgcatacaaaacaggcggagttacaaaacaacagcttgataactcgagattacagcttaaaaatgctcaggctgcagtaaaagctcagggcgtaaaagtaaacgatacaagcatccgtgcaggaatcagcggtacgatcaacaagaaaatggttgagccaggaaccgttgtttcaccggggacagcaatgtttgaaattgttaatatcaacagcttaaaactttctgttttagtagatgaaagccagatcggaaaaattcagttaggtcaggaagttcctattaaagtaaacgttttacctgaagattccttcgtaggaagaattacatttatcgctcctaagagtgatgcttctctgaatttccctgttgaaatcgaagttcagaataaaggaaaccttaaagccggtatgtatgcaactgctaaattcagtaccaacaacggcgcggaaacccagaatatgcttaccgttcctgcagaagcatttgtaaacggagtaagctcaggacaattattcattgttcagaatggcgttgcaaaattgatcaaagtaaccatcggaaaagtttacggagataaagttcagattttaagcggattgaatggaggagagcaggtagtaaccagcggacagatcaatctggacaacggatctaaagtaaacattataaagtagaacgtttatgaagttagcagaaatatcgattaaaagaccctcgctggtaattgtattatttacaattctgacgttgggaggtatcctgagttatacgctcatgggatacgaattgattccgaagtttgaaaccaatatggtaaccatttccacggtgtatccgggagcttcgcctgcagaggtggaaacatccgtgacccggaagattgaagatgccgtaggttccctggaaaacgttaaaaaagtagaatcttcttcatacgaaagtttatccgtaatcatggttcagctgaacgatggtgccgatgtagactacgccttgaatgatgcccagagaaaggtaaatgcgatccttgcagaccttccggaagatgtaaaagcaccgtctctgaataaattctccttagatgacttaccgattattacgatgagtatttcatctgataaactgaacagtaaggatctttatgacttactggataaaaagattgagcctattttctcccgtgtaaacggtgtagctcaggttgaccttgtgggtggacaggagagagaaatccaggtaaaccttgatgagaaaaaattacaggggtacggactttcaatcggagacgtacaacaggctatcctttcatccaaccttgatttccctacaggaagtctgaaaacaagaactacaaaatctacgatcagactttcaggaaaatataaatctattgaagagatgaacaaccttgtggtttccaataaaaacggagctcaggtacgtttatccgatattgcaacagttttcgactctcagaaggatgtagagaaagtagcgagattcaatcagtttcctaccattttgatgcaggttaaaaaacaatctgatgccaatgccgtagcggtatctgaaagtgttcagaaaacaattaaaacagtagaagaagcttataaagttcagggtgtaaaagtaaaaatcgtaaatgatactacagaatttacccttgaatcagccaaccacgttatttttgacttattcttagcgattatcctcgtggcaattgtaatgctattattccttcacagtatcagaaacgcgtttatcgtaatggtttcgatcccggcttcactggtagcagcgttcatcgggatgaacttaatgggatataccctgaacctgatgagcttactggggctgtcgctcgtggtaggtatcctggtggatgatgcgatcgtagtactggaaaacatttaccgtcacatggagatgggtaaaagtaagatcagagcggcgtatgacggagcatcagagatcggatttaccgttgctgcgattacattggtaattgtagtggtattcttaccgattgcaatgagttcaggtcttgtggccaacatccttgcccagttctgcgtcacggtagtaattgcaaccttattatcattgctggcttcatttaccatcattccttggttatcatcaaggttcggtaaactggaacatttaacagggaaaaactggtttgagaaattcatcctttggtttgaaggattaatcgacaagtttacacactggattacaggaattcttgaatggtgtctgaaaacgacattaagaagaatctcaacagtagtgatcacgttccttgtcttaatcagttcatttatgctggtagcattcggattcatcggaggtgaattcttcccgccgattgaccgtggtcagttccttgtacagatggaattatccaaagatgcaactgttgaaaaaaccaaccagttaacattagaagttgagaaattcttaagaaatgataaagatgttgtagaccttattacaacagtaggacaacagtctacaggttttggtggtgctcaggcaactacttaccagtctgaggttcaggtgaacttaacagataagtccgaacgttctgaaagtaccaatatcaaagctgcaaaaataaaaagacagctggaagagaaatttactggtgttgaatttaaaacggctccgatcggtatcatgggtgcagaaaatgctccgattgaaatggtagtaacaggaccggataacgctactgcagtaaaagaagcaaccagaatccttgaactattgaaaaaagtaccgggagctgtggatgccgaattatcaacagatacaggtagccctgaagttcaggtaagtatcgacagagataaaatggcttctttgggcttgaatctttcaagtgtaggacagacgatgcagactgcattcaacggaaatacagacggcaaattcagagcaggggagtatgaatatgatatcaatatccgtttcggagatgtcaacagacagtccattgatgatgttaaaaaccttatgtttaccaatcctcagggacagcaggttcgtctgagccagtttgccgatgtgaaaatgggttcaggaccaagcttacttgagcgtagagataaatctccttctgtaaaagtaagagcaaaagcggtaggtagaccggtaggggatgtagctaatgaatgggcagataagttcatgaagagcgataaaaaacctgtaggagtagattatatctggagtggagatatggaaaaccagcaggaaggtttcggtacgttaggaattgctttattggcagctatcgtattggtatacctggtaatggtttcactgtatgacagtttcgtgtatcctttcgtggtattgttctcaattccgttagcgatgatcggagtaatggtaattctagccttaactgccaactcactgaacatctttaccatgttagggatgatcatgttgattggacttgtagcgaagaatgcgatccttatcgttgactttacgaatgcgagaaaagcagcaggagccaatactcacgatgctttggtacaggctaaccacgcacgtcttcgtccgatcctgatgaccactattgcgatgatcttcggtatgttaccgatcgcattggcaacaggggccggagctgaaatgaacaaaggtcttgcatgggtagtaatcggtggtttgacatcgtcactattccttacattgatcattgtaccggtagtatattcattatttgactctcttttaagaagaatgggacaacataagaaagtagactacgaagctgaaatgaaagcagattatgtacacagagaactgaatgaagacggatttactccgaagcatttagataaataaattaaaccttttaattaattgaaagcgcctcagaacttctgaggcgcttttttgtttataattgagagaaagtgaatctgcgtataaactcattatgaattctaaatacattagatggcatatttaaaatatattctttatcagataaaattttaagtaattcagcttttaaaatgtctaattcattatgctctaagataatttgaaaataatgttttattttttcaaaactattgtgctccttatttatgaaagcttcgaaagaagatgctaattttttatacttgccgagaggtagcgcaattagaaataatactgccgtgatttcttgattttgagaaagatttgaagattgaaactcttcatgagctttaataattctataagtatttacaaaccttttaatgcatcttggattacttcctacaatttctgacatattctgcattaactcaacttcagtatctgttaatactaagttttctggttcaaactcactattttctaagacttctgaattattgttttcagtttgtccttttgtttcataatcacgataaattatttggtcggatatatttttattactgtcgtctttgattgaaacactgatgttttcaggtgctagaatttgatttagttctgttggctttttagttgtattttcttgtgcaagatttagaatcatatctttgacattagtgtcttctgcttcttttaaatgaaaaggaatttgaaatattttttctaaataatttgatacatcaatagcatctctagaatgatttccatcaaaatggatcgcatgttttttatataatgaattcttgatccatcgcgcatctacacctacaacaacaacaaaaagaggaaatgccattaaaagattaactgcttctagaacttgtactacgttttcctctgggcatctgtctaaatcatcaatgtaaagtataattctttccaaaggttttttaaacttacctttaaattcttcattggatttatttgtctcaaattctttatagtgtccaataaacaagtcatttaatatttcaaaatcttttctaataatagaaattaaaccaagatgtttttgatagtcagtgcttttggagcgtttgtcaataaatgaataaagagtttctgttgtgagagaatggtttattctgaattctaaatcaatttttactatttcagctttttgtatttgttcgcttattaaaagaatctcagctttgtttttttcaattttaagttttaatactttttctttttgttcaaatcccatttttgcttcattaatcttagcttcataggtttcttttattttccaaaaagaagagacgattggttgaagtttattatatactatttcgcctcttttccatattgcaccaatggtgattagtaatgtaagtgtggtttgtgatataagaaaattggttatattaattttgtcaataaatattttgagtatgagaggaactatagcgattaatataagaattacaaacaggtaaattatattaggataaattttatcctttcggaaaaattcttttaaaaaagtatattttgattttgcaatttcatatgtttttttcgggtctttccaataactttctggaattatttcttttaattcactaatactttcattaaaagaattattattggctaaagacttatgcaattcttcttcaatattgaattctctatttattttgttaataacgtcccaaatagagttcaattggattcgttttatattagattttatttctttctctagatttcttctttgcgattttaatttgaaaatttgatcagataacagattcttttcgattttaagtttactaatttcaccttttgcaattgataattgggaagctaatttttcttctattagccttttttctaaactactatgagtattgttggaaatataagtatttaattcctcaaaaattcgtgtaacaatacttgcccataagtttgaatcaatatatgaccatgcattaaaatgaatttgtacaactccttcacaataaaaattattccttcttgatagattattaattttttgttttagcttttgcataaaaaagctttttccggatccccatttcccaaaaagagcaattgccaaaggtggtttgaagctttttgctgaaataactttagcaaatgcatttatatctttttcaatttttaaatagtccgtaccattgtcagagtcactaattaatccagcgattttctccttaactcgagtttctgtatttgataataaaaaatcatttaaatatgaaggatttagttgggctaaaatcagtttaatttcttctttcgaaatattttgaatagttcttctaagatatcctaaatgctctatatcaatagaaatatctttaattctccaatcaacaaatactttagttccgtcttgtggattctcagtaacagttcctatcccttttattttaagatagctaattccattataaggaaaagttgattttaaaagtataatgtcactttttttaatatttaaaacgatatctgaatagctgtcatcttggtgacctttttcccagatattttcatcataaaatctcttgatctgatcattaccatcccaaatagttcctgctacaaaaaaattgatattatttttttcaataaaatttaagtgtttaaaaagaggggcatttaaattaaattgtatgttatcaaaaagttcaatgccatcatcagtttcaggtattgataacaaaaatgtagtttcaattgaagttcctctgtgaaaagaattaattgcattaactgttgttacatatacttcttcaagagatattttattgttttcgtttctagtaatagggaagaacacttttttttctataaaccagtatctaaactcttgtaatgtttcggtgagaattttctcaatactttttaatgttacatcattagtttttccaggagatatgaatattattggtgttttattttcaccttctagggttgcatatccaaatttctgtaaactttctttttgaatattgctgagatcacttcctttatacccatatttatcaagagtgtttaaagtaaaaatggataagggaccgagatgatcaatagggagtattgcaatgtctccttcatttgggtttatattaatccgagtcagataattaaattctatagatggtaagattgatggcattatagtttttagctaaaataaagttattttaacaggctacattacggaaagccataattatttacaatacaaaaaaagcttccagtaaaactgaaagctcttctatattgtagtagaaaaaattaatctgccataacctctccggactttctgtaaacgaagtttccgtagatatgtcttcttgcaaaacggcttggggaatcagcattgatcattttgatataagtattctttggaacacctatatattcgtagatattgccgttaagatgttgtaccgttaaaatcgatttttcaagatagaaatcctggatattggactttgtaatcgtttctgtatattcttctttatatttttcctgagtttccggattgatactcaccaaaaaatggtaggcttcaataacagacttgctcttttcttccgcttcctgctttcctgcttcatcattaatgaatttatcaggatgggtgtctttcatcacatttctgtaaatggtctttaattcttttaaagtaacatttttatctacgccaagaagtgttctgtgctcaccaatttttttcatatctctaatccttattttcggggtgcaaaattacggatttaaatctgataaaccataacttatttattattatttatttgattttcaacttgaaacaattttaaaacaaaaaacagcaccaatgaaagtgctgtcatatattgtataatgtaaatcttaacttttaattcttatggttcatcacaggttcttttcagttttgtaaagattttgtcaaaatctttataggaagtctcttcattatcacgtttttgtctgaaactgctgttggcacagttatgaaaacctaaaccaatcatatcaatcaaagcgtagtcttctctctgaggatcattcattttagcgtcaaatcttgccattacgcctttagggtcagcattatttttacttttaagctccgtatacattctccatgcagcatacatcttttctctgtccggagaagcaatggcgtcaatctgctctctgcaggtatcgtaatatttactgtttttaagagttgaaggatcagaataagcaatgatttcttccttattcaactggtattcattttcaaaagactggattgtttcttcctgaagttttttccatcgtggaagatcaatcacttttatactgtacagctcctttttcttttcctgatattgtttttcaagctcttctaaataagcttctctgttctgacggatttcttcaagctgggaaagcttaaatacgggacgggtatcaaaaacaacgccgttgaactggtacaaaagcttgttcactccgtctatttcttcctttttatatttagccggatcaaagtagcctttattgtcacaattgaaagtctgatagctgtatggtgtcagattatttgtttttgcaggagatttttgcccccatatagtaatggataaggccattgtaagcccgatcatcatttttttcatgtacatacgttgttgaaagaatccgaattttctgaatttcattgcaaaattaaggctttaaattcaaaatctaaagaattaaatagattttctcaattgattttgcattttttatacagattttgtagcatggctttcattcacgtttttcagacagtatatcatttactcctcaatcccgtcatagcagcgggtacagagaatttaatgtgctataaagcaggggttcttgttgacaattgctttttaggatttaaaataatagatttacatgaattaataagcatccatgatatattatgtttttcttctctgtattctcgctgtttttgcaggcatttcttctctgattatgcgttttttcggtaaatggactaagaagagtaaatacgaaactttatttaatacttttatattcattgcttcattctttctgatttcattttttagcatttatatttttctgtcaaatcttaatttttcccgataacagaagagtttcttttaagaattatataagcaataaaaagattgatcagaagagctgcccagacattcaagccataaaagagctcgtaatcatgacgggtttcattgtatagaagatttttaatgattctgaaggtaattgcagtggtggtcactgcgtagcttaaagtcatatacatcttatgcctgctgacatttcctttttttactgaaatcaaagcagcaatggtaaaatacatccaaagcacatcttgtatcagaaatccactaatcccgataaaacctccgtttgaaaacaatcccaaaacgaaacaggcaggaacattaatgatcagaatattataaacatatatgctgccaatgatcctatgaaggcttctgctttccgttaaaatccggccggaaaactgtgtaagaccagccagaaggcaaaatgttatggaaaagatatggacgtagaaaaaagccatccaatatggattgttgacaacctgttgtttaaaagcgagaaacccggtatttttatcaaaagaagtgtattgggaaatcactttcagcatcaggatactgaaaaggaagattaaaaacaaagctgcggctttaaggatttttattcccaaagatttcatagataaacttttccgggtaacgacaggtctaactttccaaaatttaaaacatcgtttatcaatcatcatttttacataattcctttcagccgtaagtgctgaagaagcataatcgttttagcatctttgatctctccgctatcaatcatttccaggcttttttcaaaagaaagttcaagcacctgtatattttcaccttcttcttccaatcctccgccatcatttattttcatttcattcgaatattctgcaatgaaaaaataaagaatttcagttacggatccgggagacatataggcttcaaataccttttctactttcgaaatcttatatccggtttcttcttccgtttcccgttttatacaatcttcaggattatcattatccagaagtcctgcacaggcctcaataagcattcctgttggatttccgttgatataagtaggcaggcggaattgtttcgtaaggattaccgtgtttgaaagtttgttgtaaagaaggataaccgctccgtttccacggtcataagcttctctgctttgagtttctgtagttccgtcctttttgcggacagaaaaagttactttatttaatgtgtaccagttgtctgataaaatttcggttttaaggatggtaatatcaggattttgcatatgggatatcttctatgttataataaatggttagtcctctttctttagctattcttacgtcctcatcagcgcctttggatgctccttctatacggagtactgcatcacatttttcgagcagggcatgagccacgggatactgtatctcctgccatgcttcatcacctatttgggtagatcccgcaaggtgtatcaatggtaacgcaacccactctcctatgataggaatatgcccttttctgtagatagggagtgcaacagattcaagacggttaagattctgctgaatcagttgcggatcatcattcgttccgctgcggtaaggtcctgcaataagtataaacataatcttttttgggtaaaataacagaactttcaggataaaaaaaataatatagcttaagagaaactgtttttttgtttgttggattttataaggcttaaaaattcaggagtaatgcctaaataagaagcaatttgcttttgcctgatgcgttttaccgcttcaggatatttgtgaagaaagttaaaataacgctcttctgctggtaaagacaggttttcaatcgttcggagttgctccctgatataagcattttgcatcatgatccggaaaaaacgttcaaattttgggaccttgagataaagttcatccagatgatctttctgaagctgtaaaatactgctttcttccaatgcttcaatattcagcatggcaggtttctgattgataaagcaatacatatcggtaatccaccagtccaccacagcaaacatgatggtagactcctttcccgaagcatccatatgaaaagctctcagaattcctgactgaacaaaattgatctctttacaaacttgttggtgctccagaattaattctttcttagccagctttctttcttttaaaagagacagaaaataagatttttcgtaatgggtaagcgaaatatgcctggaaatgttttttataattaaaagttcttccattatcctcctattgcttttttaacagatcgcgtaaagccttttccagatcaggaaacttaaaatgaaacccggcattcagaattttctctgaagaagctcgggagccttccagtatgactgaagccagttcgccaaatatcagttttaaaacaaatcctggaacattaggcatccataatggcttaccaagtactttcgcaatcttttttgtaagttctttattggtggcgtgctgtggagaaacggcattgtaagcgccctcaatcgcagaatttttcaaagcaaattcgtaaatagagcaaatgtcctcaatatgaatccagggcatgtattgttttccatttcctaaaggagaaccaatataatattgaatcggaggaaccattttcttcagagctccgtccttttcagaaagcactacagctgtccgtattttgacaactctttctgccagttcctgttctttaaaatcatctgcagctctttcccataaaacaactacttcacttaaaaaatcattgccgggcggatcggtttccacatcaattttttctgaagtctttgtaccgtagaaattaattcctgaagctgaaataaaagattttaatttaatcttgttttttcttaaagtggcccgaagtagttccgcagaatcgacacggctggagatcagttctctttttctttcaggcgtccagcgcttttctgaaatattggctcctgcaagatgaatgatgtgggaaacgttgtcaaaggcagtttcatccaccgttccttttttaaggtcccattcatattcattttcttgcttcctgtgcctggtcagaaacctgatttcatagtcttgacctattttttttgccagttctttggcaatcataccaccggctccggtaatcagaacaacttctttcataataatattgttaaggtgtagtttttatgcctgattttttacaatcagtacaaagtcatcttccagcagtttataaccgtaatcataaataaacttgtattcagaaccgtttttatagactttcagattggtaaaataatcaaaatcaaaacccaagccatccagccgggatttgggtacttttgttttaccgtctgtgttaatctccataaggatgcggtaatttttgcggagtttgttattcacattccgcatcagattattagaatccttattctgcttattgttataggcgttccggcaggcatcattacagaactttttatcagaccttccgatgattttttcgccgcattccagacaattcatgatctttattttaggtgatgtgtgtgtcttttttttagcagtttcttaaacctgctgtgggtagggtagcttctgttgggcgtaatgttattaaagaacaaagccacaagcagaagaataatgcatcctgaaagaacaggggagactacataccaataccctaattcagggattttgcccgtagagcttacagcaatgagagcggtagcacctccaggtggatgcaatgtctttgtatactgcatcagcacgatagagaaagccactgccagaggtgccgaaagccagatgatatgaggaacaaactgataaacagtaactcctacgagtgccgataaaacatggccgccaataaggtttctgggctgtgccaacggactttgtatggctccgtaaataagaacacttgaagctccgaaagaaccgatgaggaaaatattttcagtttcggccagtgaatgagactggataaatgcaataattccgatcccaaaaaacgcacctaaaaatgaccagaaatgctctttataatcaacaagcgtttccttatagattacgtactttgaaactctgaatgttctttttatactcttcttcatttagtcttctttataatttgaattaaataattgtctattggaaaattattggtaacaaagcaaaaaaggattttcaatttaaacctcgcattttgttagtgtaatttctctatataaaggattttgcatttatatattttccttcaactaatctttgtctcttattgaaattattgttgtaatcttcttcattgattgtaattagatttgttgagttatccattatatccatatatctaatttctatatcttcaagttccacagactttaatatatttcgtacaatgttttcaaattctttatcaattctgtatccaaagtatattttcacaattttcgcacgaccatcaaaatcctcatatcctggatgtccccattttctccattctttttcataactccaatgaggtgatttaacagttaagctattataaaaatctcttttcatctctactaaatctttatatggagaattgtcatcgcacattagtgatttaatgtttaatgaatctactttatctgaatacttaacttttattaaatcattttcaactaataaatcctcagaaaattcaaatgcgagacaaaaacctgtatgtgatgaagcataatgtgaccacattaaaatattattgtaatcttctgaaaatgatgaaaaacaaagtccagtcagaatatttctgcgtaggaagttaagacattcaattaattgctcgttattataatttaaccaatctgattttgtgttaatttcattttctttaatatattttctgtattgatttaaatcttcttgagagtattcttgactaattaatgtcaatgattctaaaggatcattcattttaagggctgaattcatccaaacagatttacaagagagagcttttagagaattaatgttctcggggaaatatttatataaaatcataagttaatttttggtgagaattatgtttaatgaaaaagtattgagcaagtacgagaaaagctgattattcaatttaggtagacattacaaatattttttcataaatttaaactaataaaaatgtatggaattgaaaaatagtggtgacaatatagaacgatgatctttcacaaagatacgcaattatccatttgtaaatgactagctgtgagatattcacctattttattgaaacaaactcatctttagaatgaaataactcttaacttctgaaatacagtaaattatttaaaaaacggaactgatttgagaatattctgatggctatggtagttcattttatgaaaaaaggcctaatttatttattaaaatattcttctgaatattcaagcctgtattttgtttaattttctatattttgaaaaattcaatgtttatcaatgttttaaaatatttttttattcataatatattattgtttgtaactatcttgttttcatgcaaataaattgaatttttatttcacgatattgtggttttttgtaattttgagataacattcaaaaagcaaaccatgaaaaaatccaatttattgatgagtattgtatgctcttccttcgtgtctgcacaggttgggattaatacaacctctccacaaggagttttagatgtaacctcatccaattcggcagttgtgttaaccagaaatgccaaccctccggcaaatgtaaccacacccacagcgggaatggtcatctacgattctacaattaagaccttaaggtactacaacgggatccagtggagtacggtaatttcttcgcagaccttaacaacagctaatgaaggcgttgtaaaactgaatagcggggcaggtgtgaagccttcattcgcattcagatcttccggcggagttccattaatgacttatgaaaacattgtttatcagaccccgatgaatattgtgacagactttgctgctcctcctacaactacctggccggaaaatattctcaatccggtacccggggacatatataatcctaccacgggacggtttctggaaaaccctattgcagggcaggttcatatgtggagggttattgtaagctatgccaataagaataatggttctgttgcatttgtgacagtaaacctatcaaatcctattcctccttccacattctccatagatcagacagctgttgcacccaatggggtaacatccggaaatctggtcttttatctggtgagtgttgcagatcctttatctattggcagcggatatcttattaaaataaaatctgatacatcattagatgccactattgatagtataacaagaatttctcaagccaaagattaatctcattatttaaagcttattaaacgactgatcattgaatgagaaacgtataaaattccaattctaagttagatgattaagtgaaaggtactcattagttgcttgagtgccttttttattctgatattctgatatcgtaaatggtagtcaggcctgaagttacaggagattggttgttgtcctgcagataatttcctgccttgaaataaacggattcttttttccagctgtcaccaaaatgaaaagaaacagtctgctggtttaccgttactaagacatcagcattgttttgttgaatactgtaatcaaatgtttgatctaaagaaacatttttcagaagcgtaattctttcttctttgtcattaacttcttttttgaagccagcctgaatttcaccattattccaccagatttttaaagcttcggtgcctttggaatgcccatgaatctgaccaataataatttttccggttccaggttgctgcaaaacagccatttttacacgtaaactatgttgattttcaaaattccattcttttatctggcgtaattctgttcttggaaaatgtgaaccttgggtcgttttgccattagaagaacaaaagaaacgtatgctgctatcctgaggagaaaaataaaagttatcggaggagaattgttcaatatcagatcctttaataattgtaatggaattatttttaggaataggcagttgcagatcaaatctactcagatcaaattgatgaggaactttcgtataagtatttttttgtgctgaagagagcacgggaaacaataaaaatacggtgtatgcagcgagaattttaaaatgatttctcatacaaaggaaattatgccggaataacctaaacgaatttagaacttttgttgaataatattcccgataaataattaagaaaatattaaaaattactttaccagatgtctgaaaaaagaaagtcagaataagtaataacccattctgacttcaatatatttttagcaataattttattttttcagtctttcaatttcctctttcaaaagcccaatatattcctgcatcgttttaataatttctatgcttaattcattgctgatgttagtagtattattattaccaatatttgctagagagctatcattaaatataggattctcgacaacaaattttacttcctcttcttcgtaaatttcttcaaccggaacctctagaaatttagcaagtttgttccattctgtctgtgtaatagatacagtaccactttcttttctgctgtaattggagacatcagtggggattacctcagccatttgctgctgggtaaagcctttcatctttcttactgtacggagtttttctttttgcatatcagacatttttacaaatttgcaaaaaaaaattaaattaaatagaaaaaaatcctcgttcatacttctgtttttctgtgtttttgaatggagaacaatatttttggatatgtttttgtttcattaaatttttaattaaaaagcagaaattattgccttttaatcagatgaatcctgctttatactgaattctttttgtttttgtatccgtttacaaacgactacaaacggatttaaatagtttataaccgactgtgatatcagaacatcgcaatctttgcaacagagatttgagaaaaacagtgaacgtctcttatctgaatttattaatctttaaaatctaaaagttatgtcactaagaaacaaagtaacattaattggttacacaggaaaagaagttgaaatggtaaacttcgacaacggaaatgtaaaagcaagtgtatccttagctaccagtgatcattacacgaatgccaaaggagaaaaagtagaagaaacgcaatggcacaaccttattgcctttggaaaaacagcagaaatttttgaaaaatatgttcccaaaggaaaagaaattgccgtagaaggaaagcttacctacaggtcatatgatgacaaggatggggtgaagcggtatatcacagaaattcgtgtagatgagatcctattattaggaggtaaataattctaaaaacacaaatgatgaaagtaaaagtttttaaaatcaggattcctgaagaatttctctacaaagatcagaaaatgctggatgattttctggaagccaacgaaattatgaaagtagaaacagcttttgtaagtgaagagcgctactggtctgtaatattgtactttgaagacttaaagcctgcaaaaaatacagtaaaagaaccgaagaccgtaaagtactctgccgaaagcgaaactttgaatatggatgaagaaaagatactggatgctttgaagctctggagatcagaaaaagcaaaagaacagaatcttcccacttatttcattgcaagcaataaagagctggtctctgtagcgaagtataaacctgctaaaaaagaagaattactggagatcaaagggttcggaaaacataaaattgaaaattatggtgaagaaattctcgaaattcttgaaagcatatgattttttgaaataattgataacacaacaagaaaagctgaaggaagattttcttcagcttttttatgctgtgtaaagtccctgcaattccttacttttgcatttatcaaaatgacatacaagaaatgaagccaagtttagcaaaagggacgagagattttacggcacaggaagtttccagaagaaaatatatcatcaatattttacagaataattttgaattattcgggtttcagccattggaaacaccaagttttgaaaatctttctacacttacaggaaaatacggagaagaaggtgaccgcttgatttttaaaattttaaattcaagtatcaatgaagcaaaagaagagaaaaaaactcagatgcttcatgatttccaaaaagcattggaaaaaccattcagtgcagaaagccttaccgataaagctcttcgctatgaccttaccgtaccttttgcaagatttgtagcaatgaaccatgggaaactgacctttccgttcaaacgttcgcaaattcagccggtttggagagcagacagacctcagaaaggaagattcagagaattctatcagtgtgatgcagatgtggtgggaagtgaaagcttattacaggaagtagagctggttcagttatatttaaaatcatttgctgatctgaaagttcccgttacgattcatatgaataacaggaaaatcctttccggtttggcagaatatgccggaatcacagataaactgattgacttcacggtggcattggataaactggataaaattggcaaagacggagtggtgaaagaattactggaaagagaaatttctcaggaatctatcgataaactagacttcttattcagccagtctgatgatgcactggaaaatcttcttcagctgaaagaaaaatttgcaggaaatgaaatcggactgaaaggagtagaagaactggagtttgttcttacccagtctttgaaccttggtgttgatattcaaaaccttgtattcaatattacattggccagaggtttagattactacacaggagccatctttgaagtgaaggcagatgaggttgctatgggatccatcgggggaggtggaagatatgataacctgactgaagtttttggagtgaagaatattccgggaataggaatttcattcggattagacagaatctatcttgtaatggaagaattgaaccttttccctgaagaggcgtcagccaaaatagaatatctgtttgctaactttggaggtgacggagtaacggaagctttaaaactaatgatgcagctaagagcaaaaggtatttcggcagaattgtatcctgaaaacgcgaaaatcaacaaacagtttacttacgcagaaaagaaaggcataaagaatcttgttttccttggtgaagaagaaattaaaaataatacagttacttttaaagatctggaagccggagtacagaaaacggtttcattagaagaatttttaggagaataattttttaattatataaaaacagaacaactgcaaaattacttttgtagttgttttttttgatggatgctgagaatttaaatacttttgaataaaaaagaaatgactaataattgtgcattttgtaaggcagaattaacatctatggatacgcttctgggagccaatatgctttctgatggcaatgttttatgcaataagtgtctgaatatagcaacaaatatcaatgaagaattactttataacctcaataagttcagcattgaagatatcagtaaaattctgaataatgaaaaacccggatctttagaggttgctgtaaacgcaaatcagaatctttctgcgcttacgaatatagattcaggccagatctcaagagatgtttataaaagaagacatcgcaaaataaagcaggaactggaaaaactgcgtgccaacctttctattttcaccaaaggagaaatcaaagaacttccttacctgattcctgaagatgaaccaattattgcaattacagatgctcaatttgtcaatacgttagctgcaggaatacttgtagctacctccaaaaggctgatttctgtttcaaaatcaatgttcggggcagcggagatcaatgattatcccaatgaaaccatcaaagcggtaagttttgtaacagatcccagatcacccatcattaagctgcatcttgatgaaaaggttgcagagtttgaatgttttatggataaggaagatgcagaaaagttctatgatacgataaaagctttctataacgctccacagaaactgtcttctatacaaactgatactgtaaacaaaagagccgtctcatcagaagagattttaaatcagcttgaaaaattaggaaaacttcgggaaaacggaattttgactgatgcagaatttacagagcaaaaaaagaaattgctggaacaattataaaaaacttttaatacgatgagggataaagtaacaatcgtagaaaactggcttaagggttggtgtttatcaagagaagtatcttttcctgttcaatataaatcaggtttcagagtgattgtaggagatgaaaagcaaaaagaacgttttgtatttcctaaacttaatgacgatttttttcagctcgcccactcagttcatgagccctggattcatctgaaagtatctactgctcctgaagaatttatagaaaaaattcctgaaagatgggtactgcagccacagggttatatgatgacctgctttcacccgatgcatttcagggaaatcagtcttgcaaaaggatatcacctggagttttctgagtacaatacaacttttgtggtcagaattgtgacagaaaatggggaacaggcttccattggacgtgtttctcttatagataacctggctgtttatgacaggattgttactgaaaaagatcatcagagacaaggtcttgctacttttttattgaaagagcttgagaagattgctttgtcaaaaggattttcaaataaccttttagtggcaacagaagaaggaaaactattatatcaaaccttaggctggaaggtgtattgcctgcatacttccattgtaataccatctcagagctaggtttctcaaaaagcagtaatttagatctttgaactataactataaaaatcaagaccttgttaaacaatggaaaactacttagaaataaataaaaaatcatggaatgccaaagtggagccgcatctgaagtcggatttctactttgtagatgaatttttgaaaggaaggacctctttgaattcaattgaactggagcttcttggggatataaaaggaaaaaatattctgcacctgcagtgccatttcggccaggattctatttccttatcaagaatgggagcaaaagttacaggaattgatctttctgataaagcgattgatacagccagagatctggcacagaaatgcggtacggatactgaatttatctgttcagatgtttatgatctgccgaatattctggatcataaatttgatatcgtttataccagctatggtacaataggatggcttcctgatcttgaaaagtgggcagaagttatcaatcattttctgaagccgggaggaaagttcattatggcagagtttcaccctgttgtctggatgtttgatgatgactttactaaagtagcatacaattatttcaatgaaaaaccaattgtggaaacctatgaaggaacttatgcagatcagtctgcggctatcatacaggaatatgttatgtggaatcattctttagcagaagttcttgataatttaattaagaaggatctgaaactggatacttttcaggaattcgactggtcaccatacccgtgtttcaggcatgtggaagaatttgaaaaaggaaaatggagaattccgcactttggaaacaaaataccactggtatttgctttggttgcagagaaaaaataagatttaattaaccattaagatcagataagcttttaaagaatggtttaatctttaaataaaaagtcatcgcaattaccattacgatgactttttcctatatatgaatgttaaaaaaactgctctttgttggttagcttaaagaatcttcagcttttgtttttacttcgtccactttactctgaacctgggaagccacatcattggctttgcttttaaggtcatttccccatttattcagattatcttttgctgtattgattttatcttttacagcttgttgatcttcagggcttgaattcttatatttccaataagctaatgcacctaatcctagtaaagctaataaaccttttgtcttgtttcccatgatttctatttttttaagtattaatattaaaattgttgttatgaataatgtaaaatacgtgccaaaaaaataaatggacctataaaaaaatgttaaatttaagaaaagacttcaaaattttcaccgtcaaaactggcgaaaaccatagtgggataggagtcctgatgataaatatttccatctttatcaatagcgatggcacctgcgaaaccatcaatggttttaagctcttcaaatgttttggtaaaagcctgctgaagattcatcccatcggtaaccctcgttacaatttttgcagcagtagcattgcttacaatatcttcacccacaccggtacagcttactgcacagaaagcattggcataatttccggccacagtggcagaatctgaaatccttccgggaatctcaaaaccttttccacctgtggatgttgcaacggctagtttcccttcatgatctattgctacgcagcctacagttcctttgcctccattggcaagcttggcttcatattcttttcttctctgaggagtctccgtagaaaaattctcaaacccattttccgtagcatagattttagcaccatttcctcctaaaactctgtcgtcttcattgataagatctttggcaacaaatatagggttctgtacattttcaatattgatcacgccgcttagtttctgagtatctccgttcattattgcagcactcatgcggatcacaccatcactctggatctgagatccgattccggcattgtataaaggatcatcttcaagcagcgaaacagcataggcaacagtatcaaaagccgaatgtgttgtaagataatcaaaagctttctttgcaattgattgtaaagactcctgttttgctgtctttacttcgtggctttggtcactttcagagaaaaaaccgccgtggataatgattttcatagaataagagttgatgaatatttttacgaaggtaatttattaataaaagataaaagataaaagataaaaagatattatcgtaaatcaactattatgcatccggatatcaacatcaatagaggtgggctttagcccgccttaccataaacatattaaatccattggctttagccccaacataaaatataaatgttaaataaaaaacggaaccgaggtcccgtttgtatagctgtattagttgttctatttatcctgtggaatagggttaaactgcgaattctcaatcgtcagtgttttggtagtaagatcataatggtcattcatagacatgacatgtaccgtcagattatcaatagaaatcggttccccaaggttaatattggtaaggttggtgtctttaataaaccttccgtctaccagaatcacaagacctgagcctacggctgtcatcacatcattatgaatgaaaagtcctgtatcttctcccaatccgattcccagcgttctcggattgttcactaccgcctgaaaaagacgcccgattctgcctcgctgtacaaagtgggtatcaataatgacattatcaattaatcctaatccctgtgtggttttgatttctcctttcagaagtgcttcagaactgcttccctgataaatcatattttcagaagctgcggcagcacctgcagaagttccggaataaataaagtcctgttcctgatatttcagtaaaactgtatcgtggaatcttgttcctccaagaatagaagtcagtctcagctggtctccgccagtgaacatcatgacgtctgcagcattggctcttgcaaccatagcatcagaattagcttcttcgcggttatgaatatcaaggacatttacatttttagccccaagaaattcaaatgcttttttgtattcggaacctacgatctgagggatttgagaggcagttgttacaatttcaatgacagaattctcctttagttttgattcgttgatgatctttcgcaggatcccacgctcaaaaaaattaagattcttttctatattctgatcataatcggtttcagcaaaactgcctttgtttacagcgcctccgataactattaattttccaacaggtttcatcattgtgcaaaattaaaaaataattcacattctctggccaatttcatgccatctttagttgatttttaatgttttagaaatgttaattaaaattaatttttttttagcgaatctttaaatgtggtatagtttcgtttagggttttacattatctttgattatgaaaggagttattgttaactgttaaaatgccaatagactatgaaaatcgaaaagattcaggcactaagaggtcctaacatctggagcatcagaagaaagaagctgatacagatgaggttggacttagaagaaatggagaattatcctaccaataaaatcgaaggatttcgggaaaggattgaaaaattaatcccatcattaattacacatcgctgctcggaaggagtggaaggcggttttttccatagagtggaaacaggtacctggatgggacatgtcattgagcatatcgccctggaaatacagacgctggcagggatggatgtagggtttggaagaacccgcgaaacaaaaactccgggagtgtataatgtggtattcaattatattgaagaaaacgcagggatttatgctgcagaagaatctgtaaagattgctgaagcattgatagaaggaaaagattatgatttgaatgcatgtattcacaggttaaaagaaatcagggagcgtgtccgtctgggtccttctaccggaagtattgtagaagaagccgcttccagaaaaatcccatggatcagattgggaaccaattctctggtacagctgggttacggagtcaatcagcagaggtttcaggctacgattaccggaaacacaagttctattgctgttgatatcgcctgtaacaaagaattaaccaaaagaatgcttcacgatgctgctattcccgttccgattggtgatctggtagtggatgaagagggtttagatgctgtgatcaggaaaattgggtatccgattgttttaaaacctttggatggcaaccatggaaaaggctcttccattaatgtcaacgactgggaggctgccaaaacaggcctggagcatgcgcagaaatattcaagaaaagtaattgttgaaaaatatattaccggttatgatttccgtatcctggtaattaataataaaatggtggctgcagcaagaagagttccggcccatgttgttggagacggagaattaaaccttcagcagcttatcgaaaaagaaaataaagatccgagaagaggatatgggcatgaaaatgtccttaccgaaattgagatcgataaagataccttagaattgcttgataagcttcagtatactttggaaacaatccctcagaagggagagattgtatatcttaaatctactgccaatctttctacgggaggaacgtctattgatgtaacagatatggtgcatccggaaaatatcacaatggcagaaagaatctccaaaattatcgggttggatgtctgcggtatagacgttatggcagaaaaccttacacagcctttaaaggaaagtggcggagcaattattgaagtaaacgctgctccagggttcagaatgcacctggctccaagtgaaggcttgccaaggaacgtggctgcaccggtggtagatatgctgtatcctcagggaaaaccttttaccattccaattattgcagtaacgggaaccaatggaaagacaacaacaacaaggcttatttcgcatattgtaaaaagtaacggatatagagtgggatttacaacgtcagatggaatctatattcaaaataccatgctgtctaaaggagatacgacaggaccactttctgcagaatttattctgaaagatcctacggtggaatttgcagtgctggaaacggcaaggggcggtatcttacgttcggggcttggcttttcacaatgtgatatcggggtgttgaccaatattgaggaagatcatctggggatgaatgacattcacagtttaaaagatcttaccagggtaaaacgtgttgtattggacagcgttaaaaagagcggatggagcgtattgaatgctgataatgaatattccatgaagattgtgaatgaccttgattccaatgtggcgattttcagtatggatgaaaacaatcctcatatcgtaaaatttgccaaagaaggaaagatcacctgcgtgtatgaagagggttttgtaaccattaagaaaggagactggaaaatcagaataggaaaagcaaaggatttcccgatcacgatggaaggtaaggccagatttatgattgaaaacgtattggcggccagcctggcgagttatctgtatggattcggaattgaagatatttccaattctttgagaacctttattccgagtgcccagctcactccgggaagactgaatgtttttaaattcaaaaactttaaagtactgatcgactttgcgcacaatccttccggctatgaagcaattgaagattatctgaaaaatgttgaatctaccaagaagatcggaattatctcaggcgttggagacagaagagacaatgatatcagagaatgcggaaagatagcaggcagaatgtttgatcacatcattatccgaaacgaaaaacaccttcgcggaagaaccgaagatgaaattaacggattgatcattgaaggaatgcaggctgcaggaaaagatgtaagctacgagatcattcccaaagaaatagaagcattgaaacatgccataggaatggcagaagaaggaacatttatcacggctttaagtgatgttatttccaatgctattgatctggttcaggaataccaggcgcgggagctgctggaagatgataaaaatatatagaaaaacctccggaatttccggaggttttgttttttataaagtttcttaggttcctttataatgtttgaaattttaattacataaaatatagtaatcacaacaattaaaatagggtgtttttccttcactgttttgggacttacaggtttaattttgttcatcaataaataaaatgaaatcaatgagaccaatcaattacatcgttatacattgtacagcaacacagccggatgttacaatagagagcattaaacggtattggaaggaaaacctgaaatggaaaaatccagggtatcactatatgataaaagctgatggagaaatagttaacaccttaccaattgatcaggtatccaatggcgtagcagggtggaattcccaaattatcaatatatcatacattggaggcattgataaaagcaaccatccaaaagatacaagaacgcaagagcaaaaaaaatctattgtcaagctgctaagagaattgaaatcaaaatttcctaaagctagaattcagggacacagagattttcccaatgttcataaagcatgtcctagctttgatgctaagaaagaatatgctggcttatcataagttgaagtgttgtaaggctgttagaaagcatttatggaaaacttataattaaaaagcaggccttacggtttcccgtagagtatacctccggtcaatttgtatatttacgatgtttgtgaaaacacaacatacatgttaattttttatatcctccttttgggggattttatgattaaagagattttgaggaataaaaataacctccgatatttcggaggtttgtttctataagttttcccaggttgttttgatgctctgcattttcttaagataaaaatacagcgggatgagttctaatctgagggtgaagctgatcgttggaatagtaaaagggataatagccatcatgatcagacaaatggcaatgcctatgattgcatcaattatggctgcctgtggtgcccatttttgttcaaaccaaagtccgtaggctacaacacctttgaacaggaataaagaacagatcaaaagtcctgtcattgaatagggatgatcagccttcattccatataaagataaagaagtgttagtgatcagaaagcccgacatcagtaatacagcagctactgcacctccgattaaaaagatccataggaaaactttaatccaggtgggtaataggtttcttcttcgtgttaagatgttgttgtcaaattctgcgaaacgcgttgatgtttcttccatgtattattagtttttataagttatttatccaaaaaaggcattcgaacttccgatccagatggcatcttttttattgaaatctacattcaccatggcggctttagtcattcttccaagattttccaataggataggacgttcatcattttcccgccaaatatacaacaaacggatctctgctttcgaaaaatctccgttaatatcttcaaaaatcggttcatagtacacttttctctgcagaatgtagttttccttatcctgaatagagtctgtaatttcgcgggtagggtttaaattaactccgcttcctgcgaatgaaaacaatggttttagtacaaaattttcaagattttcatgctccgggaattcatgcagaaagtaactctttggaacaaattgatgttttaataaaggcagcagaaattttgagattttaaagaaccagttcgggtgagtgatccacttgacatccacttcctcccggaaatcaaattctgttttcagatccggaatattatccagttcgtcaaatataacacggttgtagattcttttgatctctgtatgcttgccatcattttcataatacagctttcgtccttccttctttatctttgtcagacatacggttttaattcctattaatttctctgtaagtgcaaaatcaatggccgttttttgtttttccggaaaaatttcaagcagaattacattttcaggatgttcatgtcctacaatgagttcatttaagtagtttttaaaggtttcatgaggcattgggtttctgatctctgaaagaaaagggtagacctcacagtacgtttcttcatagactttttgaaaagcatacaaagaagggaaagcctgaagttctatcaactgaggttctattgctccgttttcacttttgcacactccaaaatcgatggtgaaaaaatggggctgattggtatcattgggaaccctgcagtgatcaggaatagctttttgaagcagttctgccggcattgctttaatctggctgatgatactttcactggcgtctatgagcttactctcaaattctttagtcagaaaaataggactttctgaaactctgaaagcaggagctataccgcctttttctgccaatatgcctttgagctggctgtatttttcatccgaaaactctttattgaactgttttctgtattttggaatcatattttttttctttgtgatgttaaaaaaatcgagcattgttgcccgattgttatttatagctggaagagggaagctgggagagggaagttttcaattctgaagttttaattattagttataaataaaagaatatcaataatcaataatctttgaaaataacttccagccttttatgccaaagtttcagctttcttcaaaatgttttttcttgcaaactgaaggaatcttggaaggatctgatgtctggtcagaataattttgtcttcatcatctattctgtccatagtttcaaggtatttttccataccgaagttttcgatcatggcttctctgtttttttcgtctttcagattttcgatcagagattcagggttggcttccggatgaaactgtgtcccgaatatctcttcagaaaaacgaacggccattaccgctctttcaaggttaatatgaggacggaatttttcaatcgccataatagtcattccaagctcttcaaaacggttatgatccggctcaataaactgataggctcttgaatccaccgcataaaaaggatcctgaagatttttgaataaaaattcgtctttgccctcttcggttttatgaacaggcattaccccgaaagaataggactttcttttgcagatatttcccaggttccagtgaatgcttgccagctggaatgaatggcagatcaggaaaagatactttttatcgtcatggtatttattatgctcaaaaacagcatccagaaaatcagcatatttgtcttcccatgcaagaccttcccgatgtggatttccgggtccgcctgaagaaataaaaatatcaaaatctccgatttcgggcatttcatctttatatcttacatcaaacgttttgatcaccacattttcttcagagttctgctgaaaagtttcggaaatctctttaatgtttctaaaaccttgattcacatgattgttgttcatgtccagcagagcaattcgaatatctttcattacatcatattttttgtaaagttaccaaaaatattatgaagccggctcaccatgagttataccgtactctgtttcagagatcatataatcaacgactttcgtgagatcatctgtttccttaaagatctgaagctgtctgtctgcaccggttccgttttcaaggattttccaggcgtattcaacttccttgcggcatcctaaatcgtctactacatcatcaataaattctaaaagctctttcaataaatgaggataaggaacagattcttctttcccaaaatcgataagatgagcttcaataccgcttttcgaggcacgccatttattttcgttcagcagcagccttctgtagcttctgaagctcaggttttgctggtgaagtttatatattttagctacaagactctgcataatggctgccagacatacggtttcatctatcctcagaggcatgtcacagattctgaactcaatagtaggataaaacggatgtacccgtaaatcccaccagattttcttggcattgtctatagttcctgttttcaccagaagatctacataactgtcaaattctgcaagagagttaaaatagctcggaatacccgttctggggaattttacgaaaatttcctgacgataagatttaaaacctgtgtatcttccgatccagaaaggtgaattggtagaaagagcatacacatgaggaagaaaataacgcatcacattctggattcttaccccttcttcacggttgggaattccgatatgaacatgcagtccgaaaataaggttttcacgcgcaacatctcccatatcatctacgattttaatatatctttctccctgagtaatattattttccgaccaatgagagaacgggtgggtgcctcctccggaaactcgtagtccctgttcatgggcgatattgataagatgacgtcttaaattcgttaattcagctctggcttcctgaatattctgacagattcccgtttccatttcaatcatggattcgtgcatttcgtgctttaaattttcacttaaaaccgctttgccgccttcaatgatttttgaaacatgagaaaccagatctctgctttccacatcaatgatctgatattcttcttcaattccaatagtaaactgatgatgcatttattttgtgttttttaattctttttaatgttatttaatggaatctttcacaaaggttccccaggcaatattgggttttcccggaacatattctttagctttttctatagccagttttgctgaatgctcaatgatccatgcaaagttttcttcgcctacagaatttctgtctgcgtcaggggcgggattacagaaatcaatagcataagggataccgtctcttaccgcaaattctacggtgttgaaatcatatcccagggcttcattcatagtaatggtataatcatgaatggttttcaggagtttttcaagctcctttccttctgttttatgggtggtggcatatcttaaatgcggtgcatttcttggttcataaggcatgatatgaacatactttctgcccaggcagtaaaccctgtaataatcatcaaagataatttcttcctgaaccatcatgaccagttgttccgtttcccctaatttattccagagatcatcaggattttccactctgtacacgtttttccaaccccctccgtcatgaggcttcatataagcagggaaacctacataattgaagatgtattcccagtcatgtggaaatttcaggtttctgaatgaagtttctgaagtattatccggtctttcatgggatggaagcaaaactgttttaggaagtggaattccgagtttggacatcagggcattgttgaaaaacttctcgtcagcgctccaccagaacggattgttaatcacataggtaccgttaagcgcagcgttttttaaatacgctctgtaaaagggaacgtcctgtgaaattctgtcgataatcactgcatagccataatctgcaccttgttccagtttatctataataacaggttcagctatgatatttccacctcccagttcattcactttgtctataaatgcccagggaaaagtgtcttccataccgaaaagaattcctactttttttgtcataatttttgtttttaagatgggtgtttattttttctatttgtcttttattgctttatgttaagagaaaaaagctcctatgaaagtagggaagaccattctccacaaaggccagtcgtggccgatccattttctttcatcataccagaagtctatgcctttcatcctaagaatttcagccatttcaacgtttttatctttgcagatatcctgatctgaggtgcttagtacaatatgcatatgtttgtatttccaggcctcgtcatttcggacaaactcccttgggcagttgaaatataccagatcatcagaatagccgtccataaagtttctgatactgaatgctccggaaagacaaaagagatgagaaaccacatccggaaatctggaagcaaaattagcagcatgatatcccccgaagctcgctccggcaactgccacacgatgtgttttgtgaagtttttggatataaggcacaaattcctggatcagaaactgtacataccgttcataattccttattctttgctgtggagatatcttatcatcataaaagctccagctgtcaatagtctgcacattgtaaagctttacctttgcctgttctataaaccagttgatacttccgttaagatgaaaatcatgattctgggtatactgtccctgggaagtagggaacataatgatagggtagccgtaatgcccggttacttctaccttgagactaattcccagtatatttgaataatattctgtatgttctatgtgaggcattttccttgttgggttttatcttttctaaattacgttttaccgtggaactgctgatagggtgtatattatgaattcaataacattttgaatatcaatgttacgcatcatttcaggagtttagtttgttgcttttgggaggaagaacattcagcatatctgcatgaattatttctgctgcagaatcaagtctgtcctgcacaacagaagcatctccggatttataaacaatcccgacatgataatctatgggaaggaacttgacaacttcttcacattcaaaattactgtagtccggttctttatctttaatcagggcgacaatcagacctgaataatatcctgtgggtggtgaaacatggtaatcattacctctcagaagagcatcttcaattttagcccattctctccatatattgatgttacttgatgcttctaccagatccggaatatgagcaccgccaactctggaagaggtttccaggaaataccattttccgtcttctcttccacggataaattctgtgtgggtggctccgttgacaagtccgaagttggaaaggaccctggcatttatttcttccaatgctttaaattcttcagaataccttcctaaagttttagatctgaaaacgccgccttcatgagaaacctgcattggaggggccagatattttgatgcagaggtgaatacgatttttttattaaaagtaaggctgtccacatggtaaacatctccgggtttaaaactttccagtaagaaaagatgacgttcttctccgagagtttccaaggcttcaagcagttgttctttagaggtaattttcttaatgcctgatgctgatgcttcagagcgcggctttaatacccatggagctggaacacggtctgtaaattcgtccacttcatgatcgttgaatacagcagtaaattcgggaacgctgatcccggaatcttttgctttttgtcgcattgccagcttatctctgaaatatcggtgcgtagtctgtcccattcccggaatacggaatgtttctctgattaatgcagctttttcaacgtcataatcatccagagccactacagcatctactttgcgggtcttcatcagatgggaaaagccctgaataagatgttccagattccatacggatggtttaagctcaggcatgtaaaatacctcatcaatagcgtgccatggccagtttttctctttgaggttttcagaggttaccaggataactttattgccgagcttcttcatctcgtccataaaatcataacctttgtaatagcacgaaatacatacgatagttttcttctccatataatgtttttaaagatttagtgaattttcaaaaataaaagcatttgtttattattttattaatactaaaaaatgtaatatcgtgcggttttgaaaattcactaatcaattatacagagtttttttgtaaaaaactaatttttagtgataattttcaattaaattcgcgagcaattgaaccccaaaaccagtggctgctttttctttggcataacccacatttccaaaggctactccggcaatgtccagatgagcccatttagggtggttttcaatgaattgttctaagaatttagcggcaataatacagtctccaacaggcttcagggatatgtttttcatatccgccacatcagactttatatcgtctttccagacctcccataaaggcagattccataccctctgattggtttgatcaccggtttttatcagatggtttttcagttcctcattattggagaacatggcggcacaggtatctccgaacattctgacagaacttcccgttaaagtagccagatcaataaggaaatctgttttgtagtttttagccagataagatagtccgtctgcaagaattaatctgccttccgcatcagtgtcaagaacttcaatggtttttccgttataagctgtaatcacatcacttggaagaagagccttttcagagaccgcattgtctgtaataggcagaacagcaataatgttcacaggaagtttcatttcagcagcatagatcaatgctcccaataccgctgtagcacctcccatatcagatttcatataatgaagattggcagagctctttattgatatacctccggtgtcaaataatatgcattttcctaccagcccaaaagttttcgcatttttaacggtagttttatattccagaatcgtaaatgcagcatcataagcacttccctggttgacggaaagataggcgcctaatccgagctcttcgcatttttttctgttgaatgctgtatatttcagatcatattttttagcgagatttttcaggtatgcacttaatatatccggttttttcagattggccggtttgttgagccagtcctggcaggcagtctgtccattaatcaatgcttctgttttctggctgatatggtctagttttttctgacttaaattttcaaaatgcaattcaaattttgcattccagaaagtgtgttttttatcaaaagggtagttgtaagttccggccagaagcccttttgcaaattcctcaaattgtttctcattgatgaaatcagccagtgccaacgtcggaactgcctgaagcttttctttataggtttgtgaaaattttgctgcaacctgctggatttcgaaattttgtaaggcagattttcccagtccgataaaataagtgattccttcttcatgtgcattgacaaaaacttcatacttctttcctgtgaaaaaagtggaaatatttttattgaaatttttacttgttttcgtccactcttcctctgtaaataattgaaaaatctgagtgtagtttttgttttttttattgattaatttcataaatagatgttatatttctaaagtcatacaaccgttgtcttcaatattttcaatcggcgtaaatttcctacagcttttgtatgtttagtttttaatgcttcgttgttgcggctttacttccacagggttttctgtattgtcatagaacagccattctatagctcttggaaactcctgcgaccagtaaaattcattgtgggtgccttcagggttaatatttgttttaaattcgaaatcaaaaagctttttttcttcccatcttttcagatattcttcaaaaatatgaattctcctgaccattttagaaccctcctgaccaccgccgtaaagataaatttttgttttaaaaggaactctgaaattcatcatcgggaaattattattcggttctacccaaagggaaggagagaatatcaaaagctttgaatacacttcaggataaagaaatccactatatatactgatcaatgctcccaatgaactgcccccgattccggtgttgtcgcggtcttttttagttctgtaattttcgtccacataaggttttaaagtatccgcaataaagcggatgtatttctttccttcagaaccgttggccacatgatcattatcaaaaatatattctttaattctttcctcgctgccatgttctattgctatgatgataagatcaccacgtccgtattctgcaaggatagacagttttttatcgatttcccagttgccatatccgcttccttcattgaacagattctgtgcatcctgaaggtataaaacaggataacgcttatctgtagtatgatagtcataaggaagaagtgcccagattttgcggtaacggtcaagctgtggaatataaaaattttccgaaataacttccgcagtaggaaaatactcttccttgaatggtccccagtttaatctccatttttttacaatatcagaagtgttgccggaacttttttttgctttccggttaggtgtgatgttgccgtactgatccagttccacgttctcccagccaccttttgtgaatttgtattcaatatcatcgggaagattctgattttcaatttctatgaaatagctggcagggtcaagttgcttaagctgaaaattataatctttagggttccagctgttgaaatttccggtgataaaaaccggtctgtcatctttttcttctgtataaagttcaaacctcatcgtatgtgtttaataaatgttgatgttaaatttataaaaagattgttttggaatcataaaaaatgtgaggtaaaaaatgatatatttgatagatagacgaaagccgaaattcagttgataaatatttgatgaattattaaccgcttttgccggtatttttcgtagtttcagggaaaatataaatacaaactgatcttgatgaattctgttaagacctacacgcttttcaccgatcatgatgtgtatctttttaaagaaggtagacattataagctgtatggtaaattcggtgcacattctgcagaaaaggatggcgtaaaaggagtgtatttttccgtatgggcacctaatgcaaagaaagtttccgtgatcggaaatttcaacaactggaatcataaagatcatatcctttttccaagatgggacggatccgggatctgggaaggctttattgaaggattaacctggggtaccttgtataaatacgctattgaaacacagggtggcgaaattctggaaaaaagtgatccttatgcattaagctgggagcagaatattcaggcggcttctctggtttctactacatggtatgaatggaatgatcaggaatggatggaccagcgctggaaaaaaaacagactggaagctccgttatctgtatatgagctgcacctgggttcatgggtaagagacggggagtatcctgaccgctttctgaattaccgggatattgccagaaagctggttccctatataaaagagatgggatttacccatgtagaatttatgcctgtgatggaatatccttacgagcccagctggggatatcagattaccggtttttatgctgctacctcacgttttggctcaccgcaggatctgatgtttctgattgatgagcttcacaacaatgaaattggggttatcctggattgggttccgtctcatttcccgggagatgccaatggtcttcaccgttttgatggcacttacctttatgagcatgaagatccgagaaaaggctttcatcccgattggaaatcgcatattttcaactatggaagaaatgaggttaaatcttttctgatttcaaacgccatgttctggctggatcgttatcatgccgacggattacgcgtagatgcggtaacttcaatgctccatctggattattcaagaaatgaaggagagtgggaacctaatatatatggaacgaatgtgaaccttgaagccaaagcttttctgcaggaattcaacactgctgtttacaaagagtttggagataatatcataactattgctgaagaaagttcggattttcctatgcttaccaagcctgttcatgatggtggcgtgggttttggtatgaaatggatgatgggctggatgcatgatacactggattattttaaagaagactttgaaaacaggaaattccatcaccataagctgacatttgcttccatgtatatgtataatgaaaattatatgatgcctttatcgcatgacgaagtggtacatggcaaagcaagtcttatctataaaatgaaaggtgacgaatggcagaaatttgccaatctgcgtaccttatatgtatatatgtatacgcatcccggagccaagttactttttatgggagatgaatttgggcagaccagtgaatggaattttaccagaagcctcgactggcatttgctgaaataccctgttcacaaaggaatgcaggagcttgttaaagatatgaatcacctttacagatcagaaactgccttttatgaaaatcagtttgatagaaatggttttgagtgggtggaagcggatgatctcgaaaattcaatttacatttatctgagaaaaggtaaaaaaagggacgatattgtgatggtgattttgaacctggctccgaaagttttggattataaaatcgggattcctgcaggtacccactgggaagttgttttgaattcagatgatgaaaaatacagtggaagcggagtagaacctgaaatcctgggagagaagtatgaagaatggagaaattatccaaaaacaatgaccgtgaagctgccgccattggccggaatagtgttacgtcagaagaaagataaaaaatataaattacacagaattaaacataagagataaagaatggttatttatcatttaagtacagaatgttaccctgtcgcaaaagttggtggtctggcagatgtggtcggagcacttccaaaatatcagaataaaatagaaggagtagaggcgaaggttgtaatgccctggtacaacaaatcctttgtatatgatcatgaatttgacctggtttttgatgggtttattcatcagggggccaatatgttgcaggttcaggtactgaaagaaaagacaaatgttctgggatttgagctatatatggtaagaattcccggattattagacagggacaatccctatggctaccaggatgaaagtttccagtttctggcctttcaacatggcgttctgcattggctgtctgcgatgaaaatccgccctgatgtactgcattgccatgattatcatacaggtctggtgccttttatggtagaaaattgttatgaatttgaattcctaaaaggagtaaaaacaataggaactattcataatggcgaatatcagggcatgatgaactggactatggcacaatatatgccttctttcgatgcgtatcaatggggactgatggattggaacggattgatgaatcctctggccagtatgatcaaatgtgcccatgcttttaccaccgtttctgaaggatatcttgaagaactttttataagcttccgcggactcgaaagcctggttcgtcaggaattcggaaaagcatacggaatcatcaatggtattgacacggaagtctggaatccagagacagatcctatgctggattttaattttagtattacaaatgcggtagatcaaaagaaaaaaaataaagaaaacctctgtaaagaatatggattaaaacccgaacttcctttatttgcctttatcggaaggtttgctacagagaagggtgctgatttgctgccggatgttgtatggagaagtatcaagcaaagttatggtgctttaaatattatgattctcggatcagggaatacctatattgagaataaactgaaagaatacgactatacatataccaattttgcattggatctcggatataaagaacatctttctcataagatctatgcctcggcagattttcttctgatgccttccagggtagaaccatgcggattgaatcagatgtactctatgagatacgggactgttcccgtggtaagatatacaggaggactcaaagatacggtggaagatatttcaaccggcggagcagggctgaactttacttatccgggggtagatgatgttgtacatgcgatgaacagagcaatggcgatttataatcaaaaaggcgttatggaagatcttatccatgccaatatgaattttgattttgcatgggagaaatctgcagaaaaatatatagctttatataatagctgatggtgtgaagattttcggatttcttttcctgataatgcttatgttgttttcctgtaaagaagacagaggaagttatcatggaggctattactggatctatggctacggacttccggcaatggaaaagtatgaagcaatggctggcatttccgaaaaatggaaaataaagcattactctgtcggtggttgtctggtggaatctgaagagatgaaaagaatagatgctcttaataaaaggacctacgctgcaatagaaagaaaatatggaaaaggctggagagaaaggtatcgtaaagatgttgatgactttgtaataaagagtgctgatgtaatggacgtgcttattacaaatcctctcttcagaaatgaacttaaaaaatataatattgaaatctataacctggataaagaggttttagtactgaatgataaagatgattttcgggtgactgtttataaaaacaaactccaatatgaaaacaaagaatgctttaaagtagcagtaaacactaagaacaaaacagtaagcttaataaaataaaacgccagatatttatgaatcgaaatgtaatctctattgttttaggaggaggtagaggaacaagattattcccgttaacgtataccagatcaaaaccggctgttccaattgcaggaaaatacagactagtagatattcctatctcaaactgtctgaactcaggactgaacaaaattctggtgttgacgcagtttaattctgcttccctcaattcacatatcaagaattcttatcactttgatattttcagcaaaggctttgttgatattcttgcagctgagcagaatgtagaaaatgatagctggtaccagggaacagcagatgctgtacgtcagtcaatgaagcaccttgaaaaatatgattatgactatattcttattctttcaggtgatcagttgtatcagatggatttcagggaaatgctcgacttccatattgaaaatggaggagatcttaccattgctactattcccgtgaacgcaaaagatgccacgggttttggaatcttaaagtcagatgatgaaggaaatattacctctttctatgaaaagccgggttatgatatgctggaaggcatgaaatctgaagtttcagatgaaaataaacatgcaggaaaggaattccttgcttctatgggaatttatatcttcaccaagaatatccttaaaaagatgtttgaagagggagcaggtgatgatttcggaaaagatatcattccaagttccatcggaaaatataaaacattaagctatcaatatgaaggctactggacagatatcggaaccatagaatctttctacgaagcgaatcttgatctttgtcttgatctgccacagtttaaccttttctcttcatcaccaatctataccagagcaagaatgcttccaccgtcaaaaatcaacggttcatacgtaagtaaggctgtttttggagatggatgtatcattatggcagataaaattgaaaattctgtgatcggaaacagaaccagaattgataaaggaagtaccatcgtgaactcctatgttatgggagctgatttctatcagaatacgacagaaattgtgatcaatgacagaggaggacgtccgaatatgggaatcggaaaatattgctatatagaaaaagcaatccttgataaaaactgttacattggtgacaatgtcaaaatcatcggcggaaaacatatcccggacggagattatggaacctattctgttcaggatgggattgtggttgtaaagaaaggtgctgtgattgcgccgggaacacatataggataagaattctgaataatgaaagtgtagtaataacttctcttggtaaatcagaaatcttctaaaagcatataaaaaaagaaacctgctttaggtttctttttttcgtttatcatgatcttatttagaaaataaggttagtgaatattccagttccgggtctttatgctcttttaaagattgtaggaaaaattgggtattcactgtatgatcaggaattactcccttacagttagcagcattctccttgtcatcattgttgaagaatatttccgttcttggaatagaaattgtggactttgtatgaggaagccggtacgtaagaaaccatgctgcagttgtaaagttgctgcaggaaccagtttcctttcctataattgcgcctcttttttcactttgaaacagagaagcaaaataggtggcagcagaaaaagtacggttattgatcaataatacagtctctccgtcaaaaaatgctccgtctctgggatagctttttatgtatgtattatccagtcttgagtttccaaaataataatctcctttttctgctttgtcaaaccgttgtctcatgaaattattttgatcggcaatatccgtatctgaataatagcggttggtctggggatctaccagataatctttataaatgatgtcaacaaccttagttccgtatttgtattcattattaaatgttttatctttagcaatgaaagaatacagcagaggaacattactgatggctcctccagggttattacggatatccagaataagctttttaattttcagatctttaatttcctggaaatatttttttaacctttcataaaaaaagctttcatcataagaaaacgatttcacggataaatagtaagtataggaatctattgtataaccataaattccggcgttttctgagatcagatcaacaggtaatacagaatgtctgctttcgtaatagaatctgggatatttaatgcccttcactttgagggttttctgttcgccgcttggtgttttgtattgtaaagaaaaatcattcgtacggttttttaaaacaaagggaatataaaatgacacatctatatcttccactttgatatttccgtctgcggctttaggaacagcctgtaaaagttctttggaatgtatatcattaatctccataatctcactgcccacttcaatagcatatggattggaaccattcacaaatagccggccattgtgtacataagtctgcagaggaaaaaaattaagagaacttaaaatattttcaaaataattggaatctgcactaaaggaactgtgcccgtcaccaataactctcgcaggattgttcataaggaggctgatgtaacctgggtttattttaacaatattccgaagggaatctatttttttggcgataacttccttgctgtggaatctgtaaggatttggatgctgtttctgaatgatgtcaacggcaatatcaaagtctttcaggtatccatcctgtgggatttcagaaattgagtattgggaaaatacaactgatgataacaaaaccaatggaaatgtacataacttcttcataaaataaaattaagtccttcctggaatcaatatgcataccatacataccacagattatttgatattaatcattaaatcaatattttttgatgcattattttttttcaaaacgatctgtatattgttcactctttttatttgtattatttttgtgcgatgcgtatttttaaaatcttagcggtaattattatccttttgggaggagcttatgctgcttccatgtattactttgtggacgaaagtaaaaacttcacgattgaaaaagagatcgattatcccgtggataaggtttttgcccagtttaataaccttcagaattttacaagatggaataatttttttaccagctcaccttctatagacattgattattatacgccatacgagggacagggaagtgccatcagttatgtagaccctaaaaatgatactgatggggaaatgttcatcagatatgagaaccttaataaaaccctgaaatatcagctttttgaggatgaaaatgaaaacccgacgctggttgatgttaaatttaagcccgtttctgcagaaaaaacaaaaataatctggtacgtacacactccgaaactgccggtttggaagagagtggaaaacttctggacggaggaccgttttgctgaaaatatcaacaaaagtatggtgaatcttaaaaactctttaggaaataaagtggaaaaagacaaccaaatggcagcaataaagtacgacagcttaatggtagaaaatgaagaaaacaaattgttgctgggaatcaatgtgagtacttcaaacaagaaagatgcgctttacaaaaatatcgtgatgaactataataaagtttataatttcgtgacgatggatcttggaaaaagggatgatgaattcggatatcctgtcctgattactgacgcggataatttcaaagacaaagaggtttcttatttcctcggaattccactttccaagaaaatcggagtatctgataataacttcaattttaggaccgtaaatccgtctcaaaattatgtaatttactacaaaggaaactacgaggggcgaattaaggcaattcagcagctgattcagaaagccaaaaaagacgagatgcgcttcggagatatttgccagacctttattgaacgtccgatggatggacaggaagtgaacgttaagctctcattatcagtatataagtaatttttttttaatttattttttcttaagtttttttaacggtttcagactgttctaagtcggttttttttattaaatttgaagattaattctacaaataaattttaataaatagataaactgtaataatggacagattttcattcctaaacgcagctcattctcagttaattgaggatttataccaacagtacttaaaattcccggactctctagaaccatcatggaaagctttctttcaaggctttgattttgctttggagaactacggagatgacgataacactcaatttattcaggcttcggccagcgctgccccggcagtacaacaacagatttctcaggcagtatctaacggagaagttcctgagcacatcaagaaagaatttaaagtagtaaaccttattgaggcttacagaacgagaggacacctttttacaaagactaacccggttagagagagaagacactatacccctactttagacatcgagaattttggtctttctaaagaagatttaaatacaaaattcaactgtgctgtagaaacaggaatgaaagagccgtcaactctggcagatttgatcaagcaccttgaaaacatctactgtgattcaatcggagtagaatacatgcacatcaataacgttgaagaaaaagatttcatcaaaagatggcttcaggtcaatgaaaatcatccaaacctttctgcaaacgaaaaaacagaaatcttattaaaattaaatcaggcggtagcttttgaaaactaccttcacacaaaatttgtaggacaaaaaagattctcgttagaaggaggtgaaacattaatccctgctttagatcagctgatctcaagatcttctcaattaggagtggatgaagtagtattagggatggctcacagaggtagattgaatgttcttaccaacattttcggaaaatcttacaaacagatcttctcagagtttgaagggaaagaattcgaagaagatgtattctccggtgacgttaaatatcacttgggatcatctaaaaagatcaaaacagcttccggagaagaagtatgtatcaaccttactccgaacccgtctcaccttgaaacagtagctgctttggtagaaggaatctgccgtgcaaaagtagacgacaagtacaaagactattctaaagtattgccaatcatcattcacggtgacggtgctattgcaggacaaggcattgcttacgaagttgctcagatgatgactcttgaagggtacagaacaggaggtactgttcatatcgttgttaataaccaggtttcatttacaaccaactacatggacgcaagatcttcaacatactgtacagacattgcgaaagttacagaatctcctgtaatgcacgtaaatgctgatgatgctgaggcggttgttcatgcgatccattttgctgctgatttcagagcgaaattcggtaaagatgtttatatcgaccttttaggatacagaaaatatggtcacaacgaaggtgatgagccaagattcactcagcctaacttatataaaacaatctcaaaacacccgaatccaagagaaatttataaagataaattattgaaagacagcgttacttccaacgatgtaatcgctaaaatggaaacggaattcaaggctcttttagataaagattttgatgcttctaaagagattgagaagaatgtaatggatgttttcatggctgaagattgggtaaactatccgattggtaaaagaggagcagttcagttgccggtagatacaaaatatgaccttgcgaagctgaaagaactggcaattaaaatgtcaacacttcctgcagacaaaaagttcatcaataaaattacaagacttttcgaaaaccgtatcaaagctattgaaggaaattcattagactgggcgttaggagagtggttagcttatgcaacacttcttgtagaaggtcacaatgtaagaatctcaggagaagatgtggaaagaggtaccttctctcacagacacgctgtcgtaaaaacagaagatacggaagaagaatatatcccgttaagacacgtttctgaaaacagatttgatgtattcaactctcacctttcagaatatggtgttttaggtttcgattatggatatgcaatggcttctccgaatacactaaccatatgggaagctcagttcggggatttcgtgaacggtgcacagattattgtagaccagtatctggcagctgcagaagaaaaatggaaaatccaggacggattggtaatgttattgcctcacggttcagaaggacagggagcagagcactcgtcagcaagattagagagattccttaccctttgtgctaatgaaaacatggtagtagccaatattacttcacctgccaactacttccacttattgagaagacagttgaaatggtcattcagaaaaccattggtggtaatgagccctaaatctctgttgagacatcctaaagtagtttctccgcttgaagattttgcaaacggtgcattccagccggtattagacgatcctactgcagatcctaaaaaagtggaaaaattagttctttgttcaggtaaactgtacttcgaattattagcgaagaaagaagaactgaactgtgaaaatattgcattggtaagattcgagcagttatatccgcttcagacagatgctattgaagccatcttcaacaaatatgaaaacagaaaacaattggtgtgggctcaggaagaacctgaaaacatgggggcatggtcttatatcctgagaaacttcagagatacaggaatccaggtagttgctccggtaccaagcggtgcaccagctccgggtagccacaaaatgtttgagaaaaaccaaaatgcagtaatcaacagagtcttcgacagagacgatgctcctgcaaaaagaccagtaacagcttaatttaaaataataatcaattaaaaaataaaaaatactcgatatgtcagttttagaaatgaaagttccttcaccgggcgaatcaattacagaagttgaaattgcaacttggcttgtaaaagatggtgattatgtagaaaaagatcaacctatcgccgaagtggattcagataaagcaactcttgaattgcctgcagaacaaagtggtgtaatcactttaaaagcagaagaaggtgatgtagtacaagtaggtcaggtagtttgtttaattgatatggatgctaaaaagccggaaggtgctgcacctgctgctgaggctccaaaacaggaagaggctccgaaagctgctgaacctgctaaacaggaagctccgaaacctgctgctccggtagctgcaccacaaacttatgcaacaggagctccatctccggctgctaagaaaatccttgacgaaaaaggaatggatgctgcacaggtatcaggaacaggaagagacggaagaattactaaaactgatgctgaattagcagcagtacctgcattaggaggtagccctcttactgcaacaggttcaagatctactacaacgactaaactttcagttttaagaagaaaaatcgctcagagattagtttctgtgaagaatgaaacagcgatgttgactactttcaatgaagttgacatgtctgaaatcttcagattaagaaaacaatataaagaagaatttgctcaaaagcacggcgttgggcttggtttcatgtctttcttcacaaaggctgttacaagagcattacaaatgtatccggatgtaaatgcatctattgatggtgacttcaaagtaaactatgatttctgtgatatttcaattgcagtttcaggtcctaaaggattgatggttcctgtattaagaaatgcagaaaacatgtctttcagcgctgtagaagcaaacatcaaggatcttgctacaaaagtaagagacggtaaaattactgttgatgaaatgacgggtggtactttcacaattacaaacggtggtactttcggatctatgatgtctacaccaatcatcaaccctccgcaatctgcaattcttggaatgcacaatatcatccagagaccggttgctgttgacgggcaggtagtaatcagaccaatgatgtatgtagcaatgtcttatgaccacagaattatcgacggaaaagagtctgtaggattccttgtagcggtaaaagaagcgatcgacaatcctgttggaatcttaatgggaggtgacgaaagaaaaggccttggattatagttttaacagaattataacataaatatacaatctcgcctaaaaaaggcgagatttttgtatctattaagaaaatgctacaatgatgttttcaaaaatgacttccaatatcaaagtttcagtaatacctgaatatgatagtaaaaacagttatccatccgaaaaccgttacgtttttaaatacaatatcacgatagaaaatgacggaagctttcctatcaaagtgttgaaaagaaaatggttgatttttgacgtaggatttggatatacagagattataggagatggcgtaatcggccttactcctgaaataggaaccagcgaaaatttcgcttatttctccaatgtaatgcttcgttccggagtagggaatatgagcggaaaatacctggtaaaaaacatggagacacaggagacttttgaaattgatattccaaaatttaatctgttgtctgaagtattaagtaattaatgattatcaattgcaggctaagaacccgggttcagtagtctgtaatattaaagttttttgatttttgctttcatataatcatgtacttcatcattactggtgaggaagagtttttcaaatgccagcaaagaaattttggcacatacttcagcatcagctcctgcccggtggtgggtaaaatcaatcttatgatattcagctaagggtttcagtccgtattttggaagataattccatgattttttggcaagctggatactgcacaaatagttcaatttaggggtaaacattccgtaatgctccagacatcctcttaaaacagacgcatcgaaaccggcattatgagcaatcataaggcttccgtacatcatatcctgagcctcataccatatttcatcaaacgttggagcgtcttttacatcttccggctgaattccatgcaccgcaatattgaatttgctgaaataaggaaagcttggcggtttaatcagccacgtttttgtttcaacaattttagaatcctgtaccacacaaattcccatctcacaagctgaacttttctcatgagtggcagtttcaaaatctattgcacagaaatccattattttaaaattataaggtgttgggttatttttgttgctggttactgatttttgtttggaatttaatgttcaaggttttgagtttaaagtgtaaggttaattgaagttataaatttttactcaaataaaatccttagttcataataaataagaaagtcttagttttttctaatccctggaacctatgaacatcaccttcctcccaaaaagtgtttaaaaataagccattttgattgatagaaattcttcttctgatggctttgacgaagtttccacgttcccggaatctgactgtaaaacgcaaaatgagctctcaatacagcccagagatgagaaaaaccatatttgattccaaaatatactccagcaataccatctaaacataacctgaaaaaaattacccagatcacctgtgaaacgggaagatttttaagcaacatagaaaggttgttcctcatgttcaaataggttttctgtgcgctctgtttgttgagcgttccacctcctacatggtaaacttcggactttcctgtgtaataaatcttttttcctgaattgatcagcctccagcaaaggtcaatttcttcctgatgagcaaaaaatctggcatcaaaaccgttttgctcccaaaagtcttttgagcgtatgaaaaaacaacatcctgaagcccagaaaatctctgcttcatcattatattgccctttatcttcttcaagatcatcgaaaaccctgcctctgcaatacggatatccaaggttatcaattaatccgcctgcagcacctgcaaactcgaaataacttctattgtgataggataagattttgggctgtacagctgaaatagaagggttactttccaataattccaatacaggttctgtccagttctctgtcacctccacatcagaattaagaagacaataatattcgtttttgatggctttcaacccttcattataaccgcctgcaaaaccatagttcttatcgtttttaacaatctgtactgtgggaaaatgcttttctaaaaactcaattgaatcatccgtagaaagattgtctatcacataaatatcggcattctgagaaaattgaactactccaggaagaaattgttcaagccaattcctgccgttccagtttaagatggcaactgccagttttttctgcatgtcaatctattttttttcagaatcaaaatttttgatagagtcctgatatttccattttctgtgtgaccaaagataattgtccggatgtttgtgcaaagtgttttccagcaatttatggaactttctaactacttcattctctgtaaacttttccccatccgggtaaattctgtgataattaacctgataataaccacgctttacctttttcatttcacaatagatgaaaacaaggtccattcttgtggcaagcttgtcatatcctatgaaagcaggagtacgctgattcaaaaactctaatccatacgtaatatgagcgtgatggggtgtttggtcagccacaaacatatatgctgagtcaccgttgtttttagatctgaaaatattcagaatcacttcattggcttccagtgcttcatttccgaatttattcctgactttcttcatttgattttcccagaagtcactatttacttttctgtatacaggatggcagtgcgcctgggggataattttcgccagtgcattgatccattcccaattgaaaacatggcctgccagtaaaatgatatttttaccttcctctttggcttcgtgaaataaatgctggttgatatgctgcattctcactctggattctgtttccgaaatgctgaatgatttgatggtttctaccagataatcagaaaaattgaggtagaattttttccggatctccttgatttcttcttcagacttatcagggaaagactttttcaggttttgtgtaataacctcttttctgtatccaactatatgatagttcaggaaaaagatgacgtccgaaaaaatatataatattttaagcggaagcttggaaatcagatataatattttgatcagaaaattcataaaacacgcaaatttagtgataataaaattatggttctatttttgctgagggatatatgttattttttttacttttatattatgaaaaaattgataatattcgcttctttgggattaagtgcttttgctttttcacaagaagtaaagaattcgcctgataacagaaaacaaaaaacagctcttatagtgcctgcagaacaagcaaaattagaggctcagaaaaaggctgctgaagaaaaggctaagcttcctaaaccttatgacccaaaagcagatgctcaggctgatattaataaactggttgcccaagctaagaaagaaggaaagaatgtgatgatccaggctggtggaaactggtgtatctggtgtcttcgttttaataattttgtgcagacaactcctgaactgaaggaattagtagataagaattatgtttactaccatctgaacttttctccagacaataagaatgaaaaggtttttgcccaatatggaaatccgggtgaaaaatttggttatccggtttttatcgttttggataaggatgggaaaatgattaaggttcagcaaagtgatgttttggaagaaggaaaagggtacagtaaagaaaaagtaaaagaattctttactacctggaccccaaagaaaggataaaaatataaaactgcttcagaaatgaggcagtttttatttttatgtattgatttatagatatgttataatacaaatagttaaatctgtacaaatataaccttcagcattacattaatttctttatccagcttaattttttttccgaataaggcggatatttgatatttggttcaccccatgtggctttttcaagaatggctttttgatgtgagaacgtttcaaaaccatactttccatggtaatttcctataccggaacttcctacgcctccgaatggcaggttatcattgctcagatgcatcactgtatcattgatgcaacctcctccgaatgaaagtttccgtgtaaagatttctttttcttcagaattattggtgaaaagataagctgccaatggtttttcaagctctgaaacagtgttgagaactgcattatagctttgaaaactgatgacaggcagaagaggaccgaaaatttcttcctgcatgatttcgtcattccaatctatatgattcagaatagtaggttcaatgtacaaactttcttcatcaaaatttcctccggaatagattttttctttatcaataaggcgtataagacgctggaaatttctttggttaataattcttgtatattgttcagaatccggttcatattgaaattctttaatatatttcctgagcatttccagaaactgttcctgaatggtttcttctatcagcagataatccggagctacacaggtttgcccggcattaagaaattttccccatacaattcttttggctgcaatttccagattggcatctttggtgacaatggccggggattttccgcccaactcaagcgttacaggagtaagatgttctgccgccgctttataaatgatctttccgaccttcgtgcttccggtaaaaaatattttgtcaaattttaattttaaaagagctgtcgtttcttcaatacctccttcgtacacataaagatactcagaaggaaagttttcattgatgagtgaagccattgctttcattgtattttcagcaatttcactgggtttaaggatacagcagtttccggctgccattgcaacaataacgggagaaagagataattgataaggataattccacgctccgattaccagcacacagccaaggggttccttataaattttactgtttccgagttgattgacaaggttggtccttactttctgggggtttgaaagcgcttttaaattactgatataatagtcaatatcattcagaataaaggataattcggtagtgaaggtgtcgaattttgattttccaaaatctttgttaattgcttcatacagcatattctcattagaaataataagatttttaagcttttcaaggtacatcttccggaaggcaatacctttggtttgctgtgttgcaaaaaaatctctttgcttcagtagaatactttcaattttcattggtgatttttttattaaacgtttgtatttcctggattgtattgatcggaaattatgataataattgtctattaatttaattaaaaacaatataatatcaaataattattaataaaataataaatattgaaaaaatcattgtttggtgataaaaaatattgtagatttatttgtataaaatttgcggatgagaaatttattctatctattttccttattcttctgttatttcagttacgcacaatgtacaaactgcggaattcaaaaccctactgatccaaatttccattttcccgacaatacaacggtttgtttcagttccgatatgacatttaataatccaacctttggaaccaattccaagatttgtattgcttccggcgttaccttgcaatttcagaatagtataagtggcgtagctaatgctcctgcggtttttgaagtgtatggaaaacttaattttatccagacgataaccagtgttgctgatcttgatgtacatgtttatagcactgggagtattacagtgggaggaggaaatggtaaccttaccattggaggacaggataataaaataattaatgaaggacttattgaaatgggagtgcttcaattaggtgataataccaacaatatcattgataatttcggaaatctcaatattaatgggaacctgaatatgagtaattctgcgaccactttatttagaaacgaaggcggcggcttgatatcaatcactggtaattatggaaataatgagcagagcgtgtatgtcaattgtggtactattatatctcagaacggatttaacattaatggcggtaaaatcatcaataccggcatttttactgtaggaggcgatattaatttatcaggaagcagcagcgaaattcataatttcggtctttttacttccaccggaaatatgaataatgcaccggctgatgcagttatttataatgaggggcaattgaccttaaatcaattccagggaggaaacgcagctatccagggaccttcctcatcatcaaaaaaaggatatatagtcctgcaaaatcctatacaggtaggaaacgttgttgtaggtcctaatcttgactttaggagaaccaccggcgtatctgatcccagtactatcttcatgaacagtaacccaagttttctggcgaatgttacttacgattgcgcttccacaaacagttgtagtgctcctttgatcatcaatccgggattttgtcctgccattaacggagccttacctccaatggcggttgatgatacatataccattgttgccggaggatcttctgcaggaattgtactggataatgactttgaaacctacggcggagcacaggcaacactttctaatgttttgctatcacaaatatccacttcaaactcaaatatttcattaaatacagctgacgggcatgttttagcagctccgggaacagctccgggaacgtactcgctggtttatcagatctgccagacagcttctccatcaaattgtgatacggcaatagttacggttacaatccaaggaactgtaccttgttataaaccggctgtaacagggggtacttcgctttcttcaaatttcggcattacttcactgagcagggcagatagtggagagagtaactggccgggagtgagaaaaggagcatgggtcgtattggaatcaaaaaataaaggttttgtccttaacagacttaccgatactcaggttgcagcaatccctcaggcagaccttaaagaaggaatgatgatttataataccacacagaactgcctgcaggttaatattgacggaacagcaacaggctggaagtgctttaatacccaaacctgcccggattaaaagaaaactgaactgtatgaaaaaaattaccttaataatagttatagcagctttcggatattgtaatgcccaggttgcttttgggaaaacgactttagaatcagcttcatcatctattgaattcgggaatgaaaaccgcggacttgttcttccctgggtaaccaatacatccggtattcagaatgttgtgaatggtactctgattttcgatacttcggatatgaaggtgaaagtttatcagaataatctctggaaagatctttcagtagatggaacaggtactgctgatacaagtctgcaggatggtttaacagacaagccggatgcagaagtttccgtaggggcaccatcatcagtctcaggaattctggtgctggaggataataataaagcgatgattttacctaaagtagcctctccccatcttactattgtttctcctgcagccggaatgattgtgtatgatacacaaaaaaaacagctggctgtttttaatggtacagtatggtctttttggggtgagtgatcctacatgatattccttattgctatttttaccggatggtaaagcaataaaccaattgcagtaacaagagccagccagaacagtcctgtaaaaatttccatattggaaaggaggatggattgagctgtgattttagctttaaaagccccagctgttatggaaagagaatcattcaccggaagcctggaaaccgcatttccgaaaatctgattccactgactgtaaaaaacaggattggtatctgtaagattagcgctgagtgcgtcagaatgttttaacgttaaaaataacatcaggttctgcatcagtgcatatccgatagcagttgtccagaagcgggttgttgtccccagggctgtagcattggatacatattcttccttagttcctgaaatcaaaaagaaaacaagcggcgtaaataataacccctgggctgttccctgcaggaataagggtggacagatcgtagaaagagtagtatcaggataaaaagtataggtaaaccatgcacagtcaatggcaagtaacagaaatcctgtaaagaaaacaatccttgaagatacaccgcgaaccagacacagtcccgataatacaatacccaacagcgtaccggcaacattccagtattggatgttcacaatataatcccatggccatttccatacggtagccatgatgctgtaaacattattcagtcccgagcggatcaggtaaaaaataaaaaaaaggatcattccggcaatgacatttctggaactgaaaacttcaaaatgaaaaagtggtcttttggaatttctctgtttaagcgtaaataatcctcctgaaagaagaaatataaaaaggcacatcataatggtatcggattcgaaccacatgagtcttttaccgtagataattgcataaccgccagcctgcagagaaacccaaagcaaaaaccagctggtaatatccaactgatacaaaggctttttaggaaagaatctgtttttgttgaatagtgcaataccaataatcagtacaaatacatgaaagtaaaccatcatcaggatcatatgccggaaatcataattctcaatacttgatttcagcagggaagtagtgatggttcctcccgtcagcataatcgtatacataaagagataagccaaaactttggcatgtttcgtttttaactccgcaatgatcaaaggaaggaaaatagccccctcaagcaatccgaaaattccttccagaaatctgatgaccaaaataacatgatagtcgtgggttactgacagaatataaagaataatcacagaaatagaagccatcagcagcacataatatttcacgctgaaataagccataaacctctgtaaaactaaaagggtaaccacaaatgtcccatacatcaaaatcattaaatactggatgtcatctgaatctacatccataaaagaagatgtgaaggcgctgttcgaatgtaaaagcgacaacaacatcaggtggggaaacaatgccaagatgagaagcggcagtttcagccattgtggtacccatttatgataaactgaattgtgttgcataattttttaaaacaaaaggcaaaaaagcgaaatgtagaatcgcaaaattgcggttgaatataatcagaccataagtgattttacttttagtataatacctgtttaatctgtttaaaaaaacgcgaaaagacaaaagggcaaggtgtaaagtaaaaggtaaaatggcaaatatgcttaagaaaaaattcgcagattcgctatttgcagttttgccttttcgcaaaaaaaataatttaattgtaaagtctgaaataggttgatgtaaagatattttgtactctaatattctaaaaccctcccacattcagactcatatcttcttagcgctcaccagaacattcattccggaaagcagcttttcattgtctttattgttatcaaggataatttttacaggaaatctctgttcaatttttacaaagtttccggttgcattatccggttttaccaaagaaaattgtgatccggaggcaggagacacagacagtattcttcctttaaattcaacatcagggtaagcatctgctgtaataatcacttccttgctctggtcaatctgtccgagctgtgtttctttataattggctatgatccatttctctttgcttacgatctgaaccaaagcctgaccttctttaatcaattgaccttcctgaatagttttcttacccacccatccgtcataaggagccgtaattaccgtataggaaagataaagtttagcattattaaggtttgcagaactctgctgaatctggcttttaacaggagctacctttgtctgctgttcgtttgctccggctctcactgcatttttctgctgttccaatgccagaagattagcctttgactgttcataggaagcttttacattttcaaattcctgttcggttgctgcgtcttctgccagaaggtttttatatcttttaaaatcctgttctgttctccagatatcaatttttgcagacgcaattttagcatcaatgatcttggtgtcgctttctttggtattgacaccgctttcaatagtgctgatggttgctgcattggcatgaaggttggcttctgccatctgtacctggttcaggaactccctgttgtctatgatgattaaagtgtcgcctttatggacaaactggttttcattaaactttattgttttaataaaccctgataccttgctggaaacgggagtaatatattgctcgatctgtgcgtcatttgtagtaacattttttcttgaaaaaagataaaagctgaccatcccagtaattccgctgataatcaggatccaggccagtaaagtaatggacttgttaattcttttttctttttgtgtcagttgtttctgtgccatagtttttataggtttccaatcgtatattggagttggtaatatttaagttgtctgtttatttttacggagataaggttagattcggcttccagataagcattgtccgcatctatcagttctgtgataagactaagcttattggcgtattttgttctaacaatacggtagttttctttggcctgttgaatggcttcctcagcaattttaaccttctggtctgtttcttcaaactttttatacgcttcatatacattgtgtctgattttctcttcattttcctcgatctgaagcttggcaagatcaatattttcctttgcttcctgcattttatacttattcttatacaggctttcaataggataggtaagatttactccaaccattcccagacgataagcatagggctcaggagggaagaacatcatattcgggtattttaaaaagtattctccgccagcggtgatttttggtaaataattcgctttggtaattttctgatccagctccttcagtgagaggtttttgtgggtaatttcaacagattcgtttttgtttaatgcggtttctgtcagttcatcaacatagggaatcgaagcattctctgaaatcaaatcttctgtatcaacgtgcatttcctggctttccggaagggaaagaatcgttttaagtttgtgttctgcaatctgaatgtcattatccaattcagtccggctcattgtatggtttgatagctgcagtgacgttcttaaaacttcgtttaccgttacaacaccattggctttcaaagcttttacctgcttgatgttgacagaatcttctttcattttatcattaataagactttgctgctcttttaaatgatgaatctgcagaaaagcagtaatgatctccattttaagttgtctttcatcaagatgagctttcagtgctgaaatttcagtatcaatgcccgctttcttttccgtgttcttgattttgccgcccatatatacaggaatagaagcagataatgtaaagtcgtacataccattgatgacatcatacttggttgctttgttaaacacgccattctgatgctggaacaggttggttacctgattatagctggtatgaaactcaatgtccggaagtttttccattttgagatctttctctttggtaacagacatgttctgtttcagatgactgatctggatggttttattgtttttcaaaccaatttctatagcttgttgtaagccaagatgctggtaatctatcatctgtgattgtaaaaaactgctcaataataagcacaacgctatgcacagataccggcatgcgttaaatatgatattcataaattaattaaaggatttttgctaaaaatgattttgatgcagcaaagttacgacgtcatgcatagtacccgatttgtgaaaacagaaaaagatttgctcatttacgccaaattgaaaattcttccatacctttatactatgaatgacagccattttaaagcagtagaagaggacgatgccgagttttacgtctatcacgtcctcacaggtaacgtaaccacagagattcattatcacagttctgcacaattggtttatgcagaaggcggtattgtgcatgtttttactgatcagaagcactggtaccttcctgccagatgcttcatgtggattcctgcaggaactccccactatattttctctaccagtcccaaagtggatttatttaatttttattttaaaaaagaagaaaatgaaagtggcttttttgatgaaattaacatttattccgttaataacttacttcgggagatgattttttatactaaagactgggatgggaaaatcacaaaaaatgatcattctaaatattattttctcaaagctcttaaaggtgttctacaggaaaaaaaacacaagcatctggcatttcccatacagcatccttttcccaaagatgaaacactgctgaagattgcaagatatattcatgctaaccttgaaaagccccttacgatagaatccacggcaaaagaattcggaatgagtacaagaaccctttcaaggaaattcaaggaaattctgggcatgaattacgtccgctttctacgtgcattacgaattacacgttctctggaactgatgctggaaggaaaatataatatgtatgaaatcgctatgatggtagggtacaacagtctgtcgtcattcagtaatattttcaaaaagatcattggtgtacctcctacggaataccagcataaactgagaggggataagtagagtggagtgtttgagagtttgagtttcgtgattcgggttacggggcagcgggttctacaacactggataatacttctctacataacaacttgctttttagctaaataagaaggataaaagcttatataactagtaataacagttaagatttcctacattccctttctgtgaaggggggtggattctgcaacgcaaaaagacggggtagttcaataaaaaaaccacttcaatcaattgaagtggtcttgtattgtgagaaattctcagtcgcttattaagcttcttcagttttagcttcttcttttttaggagctgcctcaaccggagcatcagatacgatatcaaactcgtagttgtactcaacatttctgtgaagtctgataagagctgtgaatttaccagttctcttgatcgtgttaccaggaattttgatgtattttttctctacagaaacaccagctttttctaaagcagcagatagatcagcattgttgatagatccgaataatttatcaccagcacctacttttgcaggaatagtgatagaagttttcttcaattgctcaactacagcgttagcagcagcgattaatttagcttcttcttcttttctagcttctaatgtagcttctaaagcagctttgtttttaggggtcgctaaaagtgcaaatccttgagggattaggaagtttctagcataaccaggctttacgtttactgtatcaaactcaagtcctaagttttctacgtctttttttaggataatttccattgttgttgtccttttttagattttagtggtctaaaatcaagttagaattaatgatgtattcagcaacaaaagaagaggttgccctcttcttttatttattttttgtcttatttcaataagtcagctacgtatggtagtaatgcaaggtgtcttgctcttttgatagcagcagaaacttttctttggtattttaaagaagttccggtgtatcttcttggtaaaattttaccttgctcgtttacgaattgtaataagaaatcagcatctttgtagtcaacgtgcttaattccgtattttttgaatctacaatatttcttttcagattttgtattgatatcaagtggagtaaggaattttacttctgattctcctcctgctgaggcttgtttagccatttcatctattgccatgtcttgtcttttttaaaaaatagggttaataattaagctttagctgcttttactttagctcttcttgttacagcgtactcaacagcgtgtttgtcaagttttgtagtaaggtaacggattactctttcgtcacgtttgaatgccaattctaagtcagctactacagaaccttctcctttaaattcgattaaagtatagaacccattctttttcaattgaatagggtaagccaatttttttaatccccagttttctttagcaacgatttcgcagttcttttctttgattagatcttcgaattttttcactgcttcctccacctgtgcatcagatagaacgggagttaaaatgaaaacagtttcgtaattgttcataatgttaaaaaatttgttaattatttcgaggtgcaaaggtagaaaatatatttcttatatgcaagaggatggagtaaatagttgagcattcccgggaagatttattttcttttggatcagtttctggtttcaacttcatctttagctctgacttccaccagaaaattcactttcaaaacatcatacaatgaatgtctgcttactaatatggaagcaatagaagatatcattccggcaagcatcagatggaatatcagcgaatgtctgtcggtcatttccagaacgataatcgctgaagtaaaaggggctctggtaattcctgtaagaaaagcaaccattccggccaggaccacaacattcgtttcattaggtgtcaaatgaatcgctcctgaaatgacggaacctatactggctcctgcagtaagggccggagcaaaaattccaccagcacctccggaagtaaaggacagggcaggccctagcattctcagaacaggaacataccagtcttcgtgcttgtctttggtaaaaagaacccgctccatgatctcttttcccgaacccagaatttctctgttgatgaaataagcaatcgaagcaataattaatgcacaaattaccaggaatatcacattggctttatctgttttcagttttttctttttccagctgttgattttaagcatgatgactgagagctgactggcaagaatgccggccgtagctgcaacaagaatgatcggaaacatgaccattaaagaaacatcattggttttcggatatcccagatataaataagaccctgccagtgtctgtgccgtaagacctgcaataattactgctgtaaacaacgctgttttaaagtaattgatatgggtttttgataattcttccaccgcaaaaacgattcctcccagcggggtgttaaatgccgccgcaagtcccgctgctgctcctgtcataatcatgttcttcttggaaatctttggccaccattcaggaaggtattcattgacttttctgaaaacggagcctgcaatctgaattgttggtccttcacgtcctacggcgccacctccgattaccagaataactgaagacaggattttgaaaaaaataatcttaaggctaagaagacttctgattttgcgatgttctttgggattggcaagttctacagctgccataacctgcggaataccgcttcctttggcgttcggagcaaattctttaacgagccaccatgaaagaacaaatccgatgggagcaataatgaaaatcatccaggcatgccagtcaaaaatgaaattcatcagatgttcgccccatgcaaatacctgtgcatacatcaccgcaaaaaagcctgtaatcacagacccaatccaaaagggaatcgcctgaagcaggttgtgcttcagctgttcgttccggatgttgtcgaaggaatttttgagggatttccgtatcaggatgaaaattttcagcatttgcaggttttgagggatgaatttacggtaaaattttggaaattatatttcgtttaaaaattttgaaatcatttcagcatttttaaccgtaagaatatcaggtataccaaagcttaaaatgctgtttctgacttcaagcttaaagctttcatcagggaagctttttattgcttcttttcttttttgggttaaaaaactcatggttttaaatgaatcacttcccacgacataaaaatctttaaaatcaggatctttaaaattcacggagaaactgctgaaaattcctgcaatcttatccattagcttctttttattaatggaaatatatccaaagtcttcttttaagttttttagtccccaaagctggatggtgtcatatttacgatctaaacgtccgcctttgaaatttattcccactttactgatgataaaaagatagaaagggttattgttcacatcctctaccaggtaacagatgcgtggaataaataacggatacatatcaaaagaactgaactgttcgtaaggagactcactaatatcaataactgaaatatcataagagagagaaagcagatcatagatttcagtaatgagcttttcatcctgttcggtgaaatcaaaaaaccttgtgacatcatatttcctgtaatccggatccattttcttatatattatttgtttaaaaataatgctaatcaatttaatttccaagaacttattataaattggatttaaataattattgtttttataaatttaagcatatttaattagttatttaataatgattttggttattgtttgttcttttgaaatcgagtgaacttaaccatataaaaaacaaaaaaacctccgattaaatcgaaggtttagtatttaaaatcaacaaaattacttattgctgattactcattacttatatttctgtgttcagatcccagttttcaaggtagtcatgaacgtgcttcagcatcattcctcccaaagaaccatctactactctgtggtcataagagtgagacatgaacatcaggtttctgattgcgattacatcaccgtcagcggtttcaagaactgcaggcttcttaacaatagctccgatggctaaaatagctacctgaggctgaggaataattggggttcccataaggtttccaaagcttcctacgttagagattgtatacgttgcaccctgagtgtcttctggtcttaattttttgtttcttgctctgtaagcaaggtcattgattgcttttgcaagacctgaaagagagagctgatccgcatttttgattactggaacaataaggtttccgtccggaagggcagtcgccataccgatgttgatatttttctttttgatgatgttatcaccatttacagaaacattgatcattgggaaatcctgaattgccttcactacagcttttacaaaaataggcatgaaagtaagcttttcaccttcacgtttttcgaatgcagctttgtttttatttctccattttacaacgttggtaacgtcagtttcaataaaagaggttacgtgtggagcaatttgttttgctttcaccatgttttcagcgatgatctttctcattctgtccataggaatgatctcatcacctgcatttaccggaaccgtagctgccggagcagatactgctactgccggttgtggagtagaagctgcctgtacaggagcggcctgctgagctggctggcttcctctgttggcaacgtaagctaatatatcttcttttgttattcttccttccaaaccgcttcctttgatggatttcagttcagtttccgaaatattttcctgttgtgcgatagattttacgagtggagaaagataaagatctcctgagaattctacgtttgaagcagctgctgtctgcaaaggctgttcaatcgtttttaaagtttcagcatccggagcagccgacggagtttcagttttcgcttcttctgaagctgtaccttctccttcaatttctaaaatagcaatggcttcacctacttttgcaacttcatctttttgctttaaaattttcacgattttccccgaaactggtgtcggaacgtctgaatctactttatctgttgcaatttctactacggagtcatcctcctttacgttatcaccttcattgaataaccaagtgataattgtcgcttccataacaccttctcccatggaaggaagcaataatttgtattctgccatttttgatttttagattttgacaaatatataaaaaaaatcggtttttttaagaaatatataatcttagctaaattcgatgtaaatattttctcccacattcagtccaaacaggcttttggcgccgtttttcctgcttcctttatagatggtaagctccaatagctggctatcattgaaaatagcagcagactgtccgtggaattccgtttctctgtcccagtccgaaaccacttctgtatggctggaaaatatccttgacaggcttaaattcctgaattttatagtaaaactgttgtaacctttgctgatattttcaaaaaaatctttattaatatttgatattatatttccgaaattatcaatataggtgacttcaccaataatcattccttccgattcattgtaaactgctcgcgggaacattaattgctttgcagaatgtatttttcgtcctatcacttcaggaagcccgccattggcaagatgtaccgctgcgggaacaaaaatatccgtagaagtgaaattgatgacatcgtcaaagcggttgttcagcgtaagttcatagatggcctcaggcttaatatcaaaaaaaataaggcttaaaaggccgttatccgctgccagaaagtaagatccgtcggccttatagagtatattttttcttgatttatggtgaaaactgtctaccgaaaggatatgaatgcttcctttaggaaaatatttgtacgcatttcttacaatataagaagtctgtataaggttgaatgcctggatttcgtgagtgatatcaataatattaacctcagggtttagagacagaattttgccttttacagcggcaactctgtagtccaaatttccgaaatccgaagtaagggtaataattgacatgagtaattttagaatagtctagtattgcaaagttatttaaataaaaagaaagcccgaaagattgttgaaaagaatttgatataaatttgaaaaaaagctttaattttaaaatctaaaaataaaaatactacatgtttgaattaacatatgatttggaagatatcgatgcaaaaatcttctatggagttaataaccaatatttcaacttaataaaatcaagctttccaaccattaaaattacaggaagagatcattttatctttgccatggggaatcaggaggctttagacatactgaaacaaaaactggatgatattgtcagttttatctccaaaaacaactcaataggactgaaagacgttgaaaatatattgaatattaaagacgaaaacgagaaacagctggtatttgaccaggatattatcgtaaaaggagtcaacggtaaagttatcaaggctaaaacgaccaatcttaaaaagctggtgaaggaaacggagaaaaaggacatggtctttgccattggtcctgcaggaaccggaaaaacatataccagtgtggcattggcagcaagagctttaagagataaagaagtaaaaagaattatcctgacaagaccggctgtagaagcaggggagagtcttggatttctgccgggcgaccttaaagaaaagctggatccgtatttacagccattatatgatgcactccgtgatatgattccacatgaaaaactggaagggtttatggagaaaaaagtaattgaagtagctccgttagctttcatgagaggacgtacactggatgatgcttttgtgattcttgatgaagcgcagaacactactcatgcgcagatgaaaatgttcctgaccagaatggggatgaatgccaagtttattattaccggtgacccaagtcagattgaccttccgaaaaatcaacagtcgggtctgaaagaggcaatgaggattttaaacggggtgaaggagattggatttgtacatcttacagaagaggatgtggtaagacatccggtagtaagaaagattatccttgcttataacgatgaagagaaaagattgaggaatgactaattctgtatcagtaaaagttttgttaactttttattaaccttaaaattaagacaaaatttggtgttttaaaaaaaaataattagtttcgcagtccttaaatgtaaaactaattaaacatgaaaaaacttttacttgctgcagcagtcgctgtaatggggatttctgcaaatgcacaggaattcagatttggtccaaaagccggatactcttattctacaattaaattaaaaggagataatcagtctgaaacttcagatcctttacatacattttatatcggtggtatcgctgaatataaattgagtgataagtttgccctacagggagaacttttatactcgccgcttggaggaaaagtaaacgtagctgaagcggatccggaagatccaactacttttttaaatgtaaaggcaaagcagacttaccatactttattggttcctatctctgctaagtatttcattacagaaggattgtctgtttctgcaggagcaagcttcggatttattctttctgcaaagcaaaaacttactgctgatttcggattcggaattccagggttcgagattgatgctaatgacgaaagagatattaaagaccagatgaacactttgaatatcgctcctttcctgggtgcagagtacgctcttgaaaatggattgttctttgatgcgagatacaatcttggtgtttctaaccttgctaaacatgctgaagggaatgaaaagctaactaacagcttcgtacaggtaggtgtaggttttaaattcggaggaaactaatgctggaattttaatatcaatcatgatataaatataaagcagggcaaattttgtcctgctttttttcgttgtagaccgttttatcttaatgatgaaaataattagtatttttgcaaagtaaaatttaaacttaaaaaaaatgaaaaaactattattactaggtgcttttgcgcttttaggaggtgttgctcaggcacaagaagggttcaaattgggtggacatattggtgttcctgtatctgatgcaagtgatgtatcttcatttacattaggagtggatgctgcttatatgtggaatattgcgaaaggttttgaccttggggtaacaacaggatattctcatttcttcggaaaagatcactttgatgatttcggatttgttcctgtggctgtttccgggaagtataaatttaaaggtgctcctatttttgtaggattagaccttggatatggtatttctacaaaagatggggtagatggtggtttctatgcacaacctaaattcggatatcagatgtccaaaggagagctgtatatcggatatcagtctatcagtaacagacgtgattatggttggtacaagcatgattggaacgtaggcgctgtcaacttaggatttaacttctttatcaaataaagacagcttaaaaataactgaactccggccgaaggccggagttttttactatataattagctttacggatgttttgatggaagtttttaaataaaatggatgttactggaatacaaaaaacaaaaaacagaaccatataataaacgtttgtttaaattttaagagttaataacttaaaaattaacaatttaggttaattgtttttgtagttttcccagaatccatggtgtttcagaggaaaagtgaaaatttaaaaaagtaaatatatttaactcttgttgataaaaagtgatttttttattcataatattgtgaaaaactcaacagtatctcttaagtatgatttatttttataaaaccctaaaaattagtactgatattaatcacattaacaaattttaatattcgtggtagccactgtaaatttgccctcagaaagtattaaaattttttacaatgaaaaaaatattattagcgggtgctgttgcactttttggtttatcaaacgctcagattgctaaaggaactacatatttatcaggatctgttggttattctcaagaagaaactaacaacggtaacgataaaaaagaaaacttcaacgtattacctacagttggatatttcgtaaacactaacttggcaatcggattaggagttggttaccaaactgaaaaaaacaccctgactagcactgtgggtaacactgtaagtgaaagcgtaactaagcaacctgcttttgttgtggctccattcgtaagaaaatactggactttatctgacaagttatatttcttcggtcaattagcagttccaatgcagtttggtaaaactgagaatgaaactaactctgtaactacagtaggaaacacagttgttacaagctctacttctactgaagctaaatacactaaaatcggtgttactgtgaagccaggtttagattatttcttaaacaagaactggtctatcgaagctactatcggtgagttcggttacagcaactacaagccaaaagatggtgatgctacaaacaactacaacttcggattgaatttatcttctgtaactttcggagttaaatatgtatttgcaaaataataaacaaagcatatagcaagaaagccctgagaaactcttagggctttttttctgtaaaactaatataatagtcatgaaaaaaatcttattgatgggcgctgtagcgcttttcggtttatcaaatgcacagattgcaaaaggaacttcttatctttccggacaggtaggatattatcacaatgaaagtaacaaattcgaaacccaaataaaggatgatgtgatcagaattcttccaacagctggatattttgttagtaacaacttagcagtaggacttggtataggctataaaagtgccgttacaaaatattatgtaagtggcgctgtcattgccaatccatatgaaattaaatatacggataatgcatttgtagtcgctccgttcgtaagaaaatactggactttatctgataaattatttttattcggacaattacaggtcccattggagtttggccaggaaaagttggattttaacagtaaaggtaatggtggagatcctatactttccgctccgtttacagaaaaaaataactacaccaacatcggagtgaatattaaaccagggctggattatttcctgactaagaactggtcaattgaagctacaataggggaattcggatacaatacttacaaaaaagacatggaaggagctaaaagaactaatgattacaaatttggaatcaatttagcttcagtgacttttggagtgaaatatgtatttgcaaaataataaacaattatatactttagccctggggttaatatcccgggcttttttaagtttgaaaactatttaattaataatcatgaaaaaaatcttattagcgtctgcaattgctttatttgcaggtctgaatgcgcaaactacattcggtgtcaaagccggttatgctttatcaaccttaaattctgatgctaacagtgtcgattttggaggaataggagcaagccttgagtctaaatccggtttctatatcggaggtttggttgaacataaactgaacaataaatttgcattacaaggagaagtggaatatgctaatctgggaggtaaagcagtggtaaaagcttccggtgttacagtaactgaaaaactgaacttcaacagaattgttattcctgtatctgcaaggtattatgcaactcctgaactgggactttatgcaggtccgtatgtaagtttcagaaccaatacaaaagctaaaattgaagtgagtggagctcagtctaatccgagcgctatcaacgaaggtgaaaaataccttgaaaactattttgataatggtctgaagtctacagaattcggtttattcttaggtgctgattataatgtgtataaaggattatttgtagatgcgcgctacagcttcggtcttacgaatatgatcaaaaatcctgtggatggagaaaaattaaagatgaatttcttccagttaggaataggatacaagtttaaatagacggatatctatataaaaaaacaaaactctcaggatttctgagagtttttttatgaataatttggactttcttattttccgaacattccacccattccaggcatattcggcattttgctcatcatctgcatcatttgttttccctgaggtccctgcatcatcttcatcattttacccatctgatcgaattgcttcatcaattgattcacgtcttcgatttttcttccggcacctttagcaattctgttttttctctgcgtattgataatagaaggttttcttctttcttcaggagtcatagagtaaataattgcctcaatgtgcttgaatgcatcatcactgatttctacatctttgattgcttttccaactccaggaatcattcccatcagatccttcatattacccatcttcttgatctggttgatctgcttaaggaaatcatcaaatccgaattcgtttttagcaatttttttgtgaagctttttagcttcttcttcatcaaactgctcctgagctctttctaccaaggaaacaacgtctcccattcccagtattctgtctgccatcctttccgggtagaaaagatctaaagcttccattttttcccctgtggagataaatttgattggtttttcaacaacagaacggattgttaaagcagcaccccctcttgtatcaccatctaattttgttagaacaactccgtcaaagttcaaagcatcgttaaatgcttttgctgtattcactgcatcctgacctgtcatagagtccactacgaaaagagtctcctgtggtttgatgaaataatgtacggatttgatctcgttcatcatctgctcatcaattgccaaacggcctgcggtatccacaatcacaacatcatgaccgtttgattttgcaaaattgatcgcattttcagcaatcgtagacgggttggtagaaccttcttcagtataaacaggaactttaatctgtcctcccagtactttcagctggtcaattgctgcaggacggtatacgtcacatgctaccagtaaaggttttttatttctttttgtctgtaaataattagcaagctttcctgagaaagtagtcttaccggatccctgaagacctgcaataaggattacagttggttttcctgaaagattgattccttcctgagaacctcccatcaggtctaccagttcatcatgaacaattttcgtcatcagctgtcccggtgtaagggaagtaagaacgttttgtcccaatgctttatcctgaactcttttggtaaggtcttttgcaactttatagttaacgtcagcatccaccaatgctctacggatctcctttacggtttccgccacgttgatttcagtaatttttcctctaccggaaatattatgcaatgccttgtctaatttatcctgtaaactattaaacatatttattgtaaattataggtttgcaaaaataaggaatttttagcatatccttatcattattttataaaccacggaatacagtactttttagatattattatcttgtatagtttattttctaatctttttttgtataatttaatattccagaaaaaataaaatatcttattctttggattaataaaaaatcaagtctgcccaagaagtcatccatatcttttgagcctgactggcgtgaaaatagaataagcttttcgtaaggctgtgatagtaaataagattttaaatcattaataccagtttcaatttgaatattttgacggaaagttttaaggataatgctttctaatcccagataatattcaatcagttcatttttttcattcaacataataatgtactcacaactctctgcgtctttctgtaagttttcttttaagaattttctatccgaggcgtaagtccaattccatttactttgatttatatatacatttttcgaaatttctactgattgtttcaaaaaccaactatcatcatgatccaaaaactctagtgaattttttttatttacaaagttttcaaagtactttgtaatattggattctttatctagtgttttgatatcatatctctttttctccaacagatagatgtcctctaattgttcagcaattttagttcccttaaaattttttaaaatattttcaataaattctataaaattattaatttctggaataatcttaacttctgaagaaaaatatttatttaatattctaggaagagactctttaagaaagtccagagttctcttaaaaaaatggcctaaaattatagttcttacttcgatgatatcaatgaaatataagtcattagctggtatattatgatcataaaaaggctctagaatattttttgtatcgatattattattcaatagctttaataggaaatagactttacttagttctccaaaaaataatccaccagagatatcattatattgaatgtctttaataattttttttgtaaactcttttagtggttcaataaaggattgatttgtattaatttgttttaagtaaaatagcccaaggctactgctgccattaaatagtgatgtgttttcaaagctgttgatttctaattgtgataaatcatagcaatagttttggttccaaggtattaaattgcctagtaatccttggttccactctgtttgaaaggaggagaaagaaagtaactccttattttcaatatattgagtaagatattttgaaaacatttctttatttaaaatatctttttcaaagtttttaaaattactttgtttaaaatcccagtttgaattgatatattgatcaatatttttaatgatatagtctatccctatatcttgagaaattgtataaataatcagaagagaatactttataccagcagcaccgaaagcaaatccaactgagttttttatatttatttcttcatgttccttccaagaaatcccattttcagcaacttcacaattatttagaatcttaagataaattaaagatatatatttggacaattcttgatctttagttagaagatacaaattcaccaaggtaagaagtgtacctgctctgccattaaaaatatagtcactggtataagaggagtttataaattccctaagatccgatatttggacaagttcaagacaaatatttatatattgatgattatttgtaatttcaaacaattgaatgagagtataaattacacctgatcttcctgcaaataatgaataatcttgagatggattttgaagacagtaatttattaaattgtcagccattttttctatcttttctaaacttattatcctaagatgataaaattctatcataagaataattactccgctataacccgaacatatgttttcaggagcattaaatgttaaagaatttttgtttttaaagtgttgttctttaaagtcttcaacagttagaagagatagcttattgcatatttgatttaggaattcaaataatttttttttctcccattcgtctattatattaataatatccgcagtatctgtattcatgcttatagttgcttggtccttagtaaatttattatttcgtagtaatattctggaaaatcagttaaaagtctatgttctaaaatttcattaattgtaggtagccccttataaaatccaacagtgtggataaaactaacagtattgggaacttgtgtgaagtttgcaataccatcaaaagatggattaatatctgaaataaaaggagaaattattttattagatttttcagctaaagcattgaataagaattgttcataaacagtattaaacatgccaatatcaattttttcaagatgcggaatatttttatcaataaattcaaatgctgattgagtatattcttgaaaaaatgcaatatcattccctccaaataacccagcattcactgaaattattttattgtttttctcgatggaatcatgcagagcctgaggaacgtagtcaaaagcctctttcaattcattaaaaaccttgtcatagaagaaaaaacccttttcaaagttttgaacaatcaaacttgctttttcaagtgataaagggaaaggtttataaatataaatatcactatcaatgtgaataaatggttctgtttgtattctataagcatgtaatttaccaactgcccaaagatcgggatgataatgattgagctcatcaagaacaaccgaaacatttgtgtatggaagtttaagtttgttgataaggatatcataacctttttcgtctgtaaccagctctactttttcgtaaaattttcttagttgcaggcaacttagggcccaactcatataattgtgttttttacttagccaccctcctttatttctgtcagttgaattaattttattattcttaaaagttggttttgtccaaaagctttgaattatcttcatgaaactgaaaaaaaatttgtttcaaaaatataaaattaattttaaataaaaagtgctgtaattcaaaagagatttatatttttggggtgagaaattaattctctacgatgttgagataaaagggaatgaaacttaacataatatcatatcgtagagaattaatctgaatttgtaatgtacagttcggtatgagaaaaaaactaaatgaccacctgaattcaatcgaaaatgatacaatggagtttttgaacgaaatagcagaaaattattcttctgctatttctttagcttcaggaagacccgatagtagattttttgatcttaaaaaaattgatttctatatcaatacttatctcaactttatttctgaaactcaaaaaaagccttatgagactgtactctccaatttggggcaatacagtgaggctagtggaattattaacgaaataatcgctaaatatttattggtagaatatggcttggaaacaaccccggaaaatattcttatcaatgtaggaactcaggaaagtctgttgatttctgttcttacactatgtaacaaagaaaatgatattattattgttgaagatccgtgttatgttgggataaaaaactatgctcttattgcaggatatgaggtttctggagtgaagcttcatacagatggtatgtgtctggattctttggaaaaaaagattctaagttatcaggaaaaaggaagacatgtcaaaatagtatatatagtttctgattttcagaatccatctgggattagaatgtctattgtaaaaaggaaagaaataatagagctagcggaaaaatatgattttttcatccttgaagataatgcctatggtgacttttgctttgcagatgagatgtttcctactttaaaaaagttagataaatacaatagagttatttatttacatacattttcaaaacttatttatccttctgtccgaataggagtaatggttgctgattataaatttgaagatgggagaagcttgagcaaccagttaaaaaaggtaaagggatatacaacggttaatacatcctctataaatcaggcgattattgctggaattttaatagacaatagtttttcattaaaggaatataatagagaaaaattagaaaatctcaaagaaaagaaaaagttaatactcgatgctttacaaaagtactttagaggtaatagtgaagtgtggtgcgaaaatattaaatggaatgatccggaaggcggttttttcatggttattgatttaccgtttaaagtaacacaggaggatgttattacatgtgctgaagtatttggcgtaatctttacacccatgtcttttttccaattagatgaaattaatgagaaaaatataaggattgcatatagcaatataaaagaagatagaataatcactgcagttgaaagactttacaatttttttaaaaacaaaaatgagaatgaaaaaaaagaatgttaaatcggaacttcacaatatcaaaattgagtttgtagaattttatgtaggaacggcaaaagctgtagtgtattggcatgttaaagctttaggatttaaagtaattgcctattgtggccccgaaacagggaacactgaaaaggtttcatatttgattgttaaaaatgatatcaaattaataattacatcagctataaaccctctttctcatcacatattatcttatgtaaatttacatggtgatgctattaagagaattggaattaaagtaagtgatgtagcggcttattttaataaatccatatcaaaaggaggtattccaattgaaggtccccaagcattaagcgatgatagtggtgtagtagagtatgccattttgaaattgtttgatgataacgaaatattcttgattgataatagtggctatgttggggattttatgcctggatttataaatattgagactgattgggaagatatcaatgaagaaaattctgaaatttcggaaattgatcatatagcatgtgctttaagaataaatgagatgtttctatgggaagattatctgaataatattctggcttcaaaaacaattgaagaatatgatgaaagaaaaacattagacagtgataagaaaataggaatgtatttaaaggcgttacagacgcaaaataaaaaaatcaataaagtattggtagaacctgaattaaataagaagaatcaagttcaattatatattaccgaaaattacgggtcaggaatacaacatttagcatttaaaacaaataacattgttaaaactgtcgaagtattaaagaaaaatggtgtaaaattcaataattaccctgactcctactatgtatccttacagcagaaatatccagatatggatattcaagatctcaaaaagtatgggattttatgtgatgtagatgaaaattccctactattacagactttcacttctcccatcggagatagacctacttttttttatgaatttattcagagggttaatgactatgatggttttggcttaaataacatacaagcattatttgaggcactggaaggtgaaattatgaaataatttatgaataacaaaaaagctaagcttgacaaattgacgtcaattgtagggacagaacgcttattaccatacattggaaagaaatatgaagaacaatcttttagtccattggctgttatttttcctaaaactacatttgaagtttcagagattatgaaattttgctatactactaatcttaaagtaactgttagaggaggaggaagtaatgtaaatggtggagcaatgtcatgtggaggtgatattattttatcattggaaaaactgaacagcatattagagattaataaaattgaaagaatcgtaactgtagaagctggagttgtaacagaagtattacaaaaagaggtgaagaagtatggattatgctttcctcaaaatatcagtagtgcaggaatgagttttatcggaggaaatattgctatacgaagtggaagtcccaaatcatttaaatatggtacaactgcaaactatatactgaatctcgaagtagtactccctgacggacaggttatttggacaggaaagaatgttaaaaaggactcttcaggatataatcttactcaattatttacaggaagtgaaggaacattagggatcattacaaaagcggttattaagcttatcccattgaaaaaagaatggcttttctttatatcatttccttcaataagtgatatgtatgatttcattaacgaagttcttaccttgggactcaatccttcaagtatagagtttttggatacaaagggttttgagctggtctgcaattatttgaaagatacgagaatgattgttaatactggtttctgtatctggatggagtttgaaactgaagtctggcaatctgaacttcctgaattggaagtcatgaatcaactgattggcaaatattctaatgataatgctttgtttgcggaatcatcaagagagaaagaagagttgtggaagtataggaataaaataggagaagcatgtttagattattctgaatttgttgattatgatttttctattccattttctgtttcccaagaggtatatgaaaagattacagcaatcctcgaagaatttaattttgaaagtataatcgttggacatattggtgatggaaattttcatatcaatgttttttgtgacaaaggtttgtcttcagaacaatgggagtcaaaaatatatcaatgttttatgatgatcacctcagttatagtaaattttggaggaagtgttccaggggagcatggagtaggttatctgaataaaaaatattttaatctttcagtaggtgaaaaacaaatagaactgatgaatggaattaaaagaatttttgatccgaaaagtattttaaattttgacaaaatattttaataaaaattgaacactcatactaaaattatagctttaccttttgctggaggagggaaacattcattttatcgatttgcagaaaaagtctctcacttttatactgttgaatatccaggtaggggaagtaggtttaatgattcgtctattgacaatatcgaacttttacttgaagatttactacacaccattttacctcatataaatacctcatataagtactttttgtatgggcatagcatgggagcactgttagcatatttactatcacataaaattgaagaaataggattacaattaccttccaaattgattgtttcaggtaaaaattctccttgttgtccaagaaagcgtgaaaaaatctcagatcttccttcggacgaattttggagggaactgaagtcatatggtgggatttccgaagaaattatcgctaatgaagatattcgaacgcattatgaacctatcataaaatcagattttaagattgtcgaaaattttgaatataagccaatgaaacctttatcaataccaattgatatcttctatggtgatgatgaagagatagaggactttgaaatcataaagtgggaggagaaaacaatgaaaacagttaatattaaaaaaatgaagggtaaccatttttttatatataggcatgaacaatatttagttcaatattttaacaatttacaaaaaccatttaaaactcatatatgataaagatctctagaaaaagaattcttatgctttttcttttttcgatccctaatactttgtttagctttttgatgcttcatatcataaatagtgttgtaacagacggagtttctattattaaagaatataaaggaattgctttttttctattggcgatattatcatatatttttactttattattccaaaaaaaacttatatatctttccaaaacgttcgtttatgataatgaattaaagatattccaggcattacaaaaaacttctttgggtaaaattgaaaaattaggcacggaaagaatttatagcatagttgaagatattagagtatatatttttttgccagatactatggttactgcattaaactcctttttaacacttttggtttatataggatatcttatttatatatcaagtttctcgactattattattgttattttattggtttccatgatcacttgtcatataatcgtaggaaaaaagttgtctaagaaagtagaagaaatcaaaaaatacaatgataaatatttcaagtttgtagaagactctatcaaaggatttaaacaatttaaaataagtaaaaccaaaacacaaaacttatataaaaaatttctaagtcccaatagagaagctgcaaaaagaaaagatatcatactgtcaaacagctttttgggagtaaatcttcttagccaatatggattatatttcattttagggaccattttatttattttgcctgcacttaatgtccttgagaaagataagattaattcttttctagttgtattcctatttatcttaggaccaattatgaccttagtttcaacacaagagtttttcactcgaatttttacagcagaaaagaggatcaaggatttttttaatgattttacagcagaaaaagaggtaaatataactccaaaaatcaaaaaatttgaaaagttagaagttagagatctctattttgagtatgataacaatgaaaataatttcacactaaaatcaattaatttctcagttaataaaggagaaattatttttattgttggaggaaatgggtcaggtaaaactacatttatgaatgttctttcagggctttacaaaccgactaatggacaagttctgttaaatgatcaaataattgataataatgatagtaattataaagatattttttctatcgttttttctgacagtcacttgttttctgaaaactataataatttttcgctttctaggaataataaatttgctagtttgttagagctaatgaagctaaaaaatattgttaaatataatgatgaagatttttctataccgccactgtcttcgggacaaaccaaaagaatgcttttgataatgagtttgttggaagaaacacctgtgattcttcttgatgaatgggctgcagaacaggacccgttttttagaaattatttctatagaatattattaccgatgctaagagaagaaggaaaaactataattgctataactcatgatgatgaatattttgatgttgctgacagagttgtaaaatttgaatacggaaaaatattataaataaaactaattaaatcatgaaacttactttatctcaaaaagatatatacaatgaacaattattatttcctgatttacctatttacaacatcggaggtaaaatagaaataaaaggttttatttgtaccaacactttgtataaagcatgtaatcagtttataagagatcatgattcttatagaatgattgttaaagaagaatcggaagaaccacagatagtgtttttagaaaaatatgattttcagatagaatatagagactttagtgaacaggaagatgctaagggaagtgcagaagcatatctgaagaaagaattttcaattccttttagttttagtaatcaaaaactattaaacagatttattttggttaaaatgtctgaggagtttcattgtttgtttacttactatcatcatattattacagatggttgggggtcttcgttaatgattcaacgtattattcaaaattacaatgagatggttacctatggaaaaacaatctctatttatgattttaaataccaagactatgtattggaagatattgaatatcaaaagtcaaaaatatttgaggaagataaaaactattggataaataagtttatagataatattccaaatcaaatttttagaaaaaaaattaattcaactggtctttttaagagcgagagagaggaattaattattgacaggtcattttataatgaattgttaaaattttgtgaaaataaaaacactactttttttcattttatactggcttcattattctcctatgtaggaattagccgctctttaaatgcaatagcgataggtattccaacacttaacagaagtagtcgtaaatataagaagacagctggactttttgctggaatatcaccattaaaaattaatttaaattatagtgagacgtttacggatctattaaaaacaatttctagagaacttagagatgattatcgtcatcaaagatttcctctgggaaagttgatgaatgaacttaatttatcagatcccaatgaattgtttaatattgttctttcatatgaaaagcatgattatgcacatcattttatagatacaataaccgaagtaattcctttcaatcacggattcgaaagagtagctatggctatgtatataagagaatggtatgataatgatgatgtaagaattcactttgactataatcagaattatttggataaagaagaggtttctaattttgttgaaaactttttttattttattaagaaaattcttattgaatatgaaaaacctttaaatgaattatcttatctgatcccatctgatgtggacaaacttttatatggttttaaccagacggatgctgcttatccccaggataaaacagtgattgatctttttgaatcacaggtgttattgactcctggtaatacagcgttaatttttgaagggatatccctgagttatcgagagcttgatgagcgttccaaccaatttgcccattatcttcgcagtccgt

SEQ ID NO: 19 - DNA, 73745 bp, Chryseobacterium sp.
ctgtttatgtcctttaggagtagtaggagagatctgtatttctggggtgggagttgcacggggatatttaaacaatgaattattaacaaaggagaagtttgtttctaatccttatcttccgggcgagcgtatgtataaaacaggagatttgggccgttggctttctaatgggagtattgaatatataggaaggaaggacagtcaggtaaagatccggggttaccgtattgaattgggagagatcgagctagctcttcaggggtatcctgatgtaagtggtagtgtagtattggcagttgagaatactgacggccataaagagctggctgcttatattacgggaagtactgatttaagcattgtctcacttcgtgactatttacgtggagttttacctgattatatggttcctggtcattatatccagctggaaagttttcctttgacatctaatggtaagctggatcgtaatagtttaccagatgcgtttggatcctctttaggatcggggagagaatatgtagcagcgcgtaatgaaacagaagagaaattaatttctatctgggaaaatgttttagggaaatcgggaataggaattaaagataatttctttgaattaggagggcatagtttgaaagcgattcaaatgataaattcagttcgaaaagaatttaattataaattaattgtatctgtgctatacgaaaatcaaactattgaacatttaagtgaagctattataaaagcagataatacaaatatattagttaaaatgaatacagaaggtagtaaaaaacctttcttttttgttcccaccattataggcgatgttttctcattccatacattatccgaattattagggaaaaaccagcctttttatggtttccaatctccgaacctttatctttcaaagaaaaaaacttcatactctatatctgaaatagctgaaaagataatttcagaaatgcaaaggatagatcccaaaggaccttatacattaggaggctattcttatggtgggcttattgtttacgagatatgttctcaattacaaaataagggaatgaaattaaatgaagtttttttcattgactgtaaaccaccacaaaagaataaaacaataacacactttgaaatcaaagattctatagtttctttttgtaacatggtcaattttatgaatgattcaagaggtagaacagatttaaaaatagatattaatgatttcgaaaagaatacattagataatcaattattatgtctccatgaaaaatttatagatctaggatttttatttagcgtagaaatgttggaatcttatatgtatgaatatatgaggagtgttcagaatatgattgaatataccccttcccatattaaaattgatgcagatattaaattgataaagtcttataattatggaaatcatgcagataattatggttgggaggaattttcttataaaaataaattaacaggtattgaagttgattgtgaccacttagaacttcttaatgagaaaaacattttaaaatatatacatatcttaaaaaaataattcaaatgaatattatagtaacaggagcaagtagaggaatcggatatgatactgtattagaattcagtaaaaataataaaaataaaattattgccatatcaagagatatggcaagattggaagaattaaaacaaagatgtaatgaaaattatggtaatgagattcatgttatttcacatgatattacagatgatcaaaacaaattaaaaaatgaattaaaggattatgagaatattgatatcttaataaataatgcaggtctacttattaataagccttttttagatttatctattgaagattggcaggaaacattcaatgtaaatttatttggagcagttaaaattatacaatctgtttttgataaaatagtaaaaagcaaatatgctcatatagtaaatataggaagtatgggaggaatcagtatagctcaaaagtttgaaggattatcagcttattctagtagtaaatctgcactggcaaaccttactgaatgtctagctgaagagtttaaagattataaagtatctataaattgtctatgcttaggggctgtagacacagaaatgctaagacttgcttttccggaatgtaaagattcttttcaaagtgtagatatagcaaaatttatttgtgacttttcatttaattacgccagattattcaatggtaaaattattcccgtttcttcagcaaccccctaaaatgtaaattgtaaaatatgaaagttaaagtttccagacgtgcaacattcaatgctgcacaccgattacataataatttatggagtgatgctaaaaataaagaaatcttcggaaagtgtaataacccctattatcatggacataattatacattgtttacatcggttacaggtaaggtctgtaaagaaactggattcgtgatcgacttaggttatttgaataatctggtcaatgaattaattatagattatttagatcataaaaatctaaatttagaaattattgaatttagagatttaaatcctacacttgaaaatatgctgattgttatttataataaattaagaaataagattgatgaaaaatacagactggaggtaaagttgtttgaaacagaaaataattttgcagagatttctgatttagaataaagatttaataaaagtgaatagagaggaaatatagttttatacttatttatgttgtagttaaatgtttagtgttatttttgcgtcatgaattttctagatagtttcattgtaattttattaatagccatccttaatattatagtatatataatatttaaaaagtatttatatagaaaacctgatgcaggaatgaaattcttaactattaatatatccaaggatattatttggcttgtcacttctcttcttattttagaaaaaagtaaagctaattttctcttcattgtgatctgctttattattgcatcattctttatttatttatccataataaaactcattaataagtcttgatttttttgatgataaaaatcaatttttaatattggtaaagtttaataaaatcgatatatttgcacacgattaaaaaagagatatgaacagaaaaatttcttcattatttttcgcatttttatttgtgtttataagcagtttagcttctgctcaacatgaatctgatggagagaaatcagcggaaaaagtagagaacaaagaggcgaaagatggcttcaatgcgaccacaatgatcatggaacacattggtgattctaatgaatggcatttatggactacaaaagatgatagtggtgaagaacatcacgtttctatccctttgccaattatcattaaggataatgaaggatggcatactttcctttctagcagtatagcgcacggacacgaacatgatgggtatactttagaagatgggcaggtggtttctactaaaggtgttgaaaaagctactttgttttcaatcattagtggaaaacaaaaatcaaatgaagtgttttttgatctttcaatcacaaaaaatacggcttcaatgttcttgtcagtgatttttatggcagtagtgtttatcggtatggcaagaaattataagaaatctcaacttccaaggggtattggaaaattaatggagcccgtaatagtgtttatcagagacgaagtagctattccaaacattgggtctgttaagtataaaagatatatgccttatttattaactgcatttttctttatttggattaacaacttgtttggattgattcctttcttcccttttggagctaacctcacaggtaacattgcaattacagcagtattagctatcattacattattaatcacattattcagtgcgaataaagattactggaaacacatctttatgccgccggttccaatcttattgtatccaattatggttccaattgagattatcgggatcttcacaaagcctttcgctttaatgatgcgacttttcgctaacgttacagcgggacacattatgatcttggcgatcgtttcattgatctttattttcaaaactccattattaggatttgcatctgtaccattagcattatttgtttcagtattggaattattggtagctgcattacaagcctatatcttcactgtattatccgcactatttatcggaattgcagttgcagagcatgaacatgagcatggtcacgaagaacacgctcattaattaaaagagaataattttaaaaataatttttaactaatataatttatttattatggatttatcaacaggagcaggattaatttacgtaggtatcggtttagcagtactaggtgtaggtctaggtatcggtaaaatcggtggtcacgcaatggacgctatcgctagacagccagaacaagctggtaagattcaaggagcaatgcttattgctgctggtcttattgaaggtgctggtcttatcgcgatcatctttggtgctttcatcaagtaatctatcctcaaaaaacattcttagcagcaaagcggttggctgctgctaagaattttaaaaacaatccataaaataacatttaaaaaaagaatttacagatatgggaattatagaacctggaattggacttttattttggatgacgcttacttttgttatcctattgtttcttcttgctaaattcgcttggaaaccaattgtaaatgctgttaatgagagagaaacttctatcgttgatgctttaaaccaagctaaattggctaaaaaagagatggaagagctgaaagctgataacgaaagaatcattcgtgaagctaaaatcgaaagagatgctatccttaaagaagctagagaaattaaagacagaatcgtaggagaagctaaggatgttgctaaagctgaaggagacaaaatgatcgaagctgctaaacagactatcaacgctgagaaaaatgctgctatggcagacatcaaaactcaaatcggtactttatctgtaaacattgctgaatctatcttgaagcaaaagttagacaacagcgaagctcaaaacgaattagttcaaaattatttaaacaaatcaaaccttaactaataatgcttacatctaaagtagctaaaagatacgcacaaggtttacttgacttcaccaacgaggcagggcaaacggctactgtattttcagaaatgaaagatgtagtaaaggtaatggctgaatctaaagatttaaacaagtttttccttactccttacatcgattctaaaaagaaaatagaagtagcaaacgaaatattcaaaggtttatctgtttcttctcaaaatctgatcagattggtgattaaacacggacgtgaaaaccaattgaaaaatatcgctcaggaattcatcaataaagttgaagaccttagtggtgtacagagagtaacgcttactacagcaactccgctttcaaaagaaaaccttgaccagattttaagatctacaaatcttgtaaatgctgattcaaactttgatctgaaagtaaatgttaagcctgaaattcttggaggatatattctgagagtaggtgaccagcaggtagatgcgtctgtgaagacaaaactgaaccaagttaaaaaagatttccaattaaattaagaaaaacaaccatacaatggcagaaataaatccggcagaagtatctgcgatcttaaaacagcaattggccaacttcgatactcaatccaacgttgaggaagtaggtacagttttaaccatcggtgatggtattgctcgtgtatacgggttagaaaacgtacaatacggagagttggtgaaattttctagtgatgtagaaggtattgtacttaaccttgaagaagacaacgtgggtgttgctctacttggtgaaagtaaattagtaaaagaaggtgatacagtaagaagaacaaacagaatctcttctatcaaagtaggagaaggaatgttaggaagagtagtagatactcttggtaacccaatcgatggtaaaggtcctattactggggatttatacgaaatgccattggaaagaaaagctcctggagttatcttcagacagccggtaactgagcctttacagtcaggtatcgttgcgatcgactctatgatccctgtaggaagaggacagagagagcttatcatcggtgacagacaaacaggtaaaactactgttgcgatcgatacgatcatcaaccaaaaagaattctttgatgctggtaaaccagtatattgtatatatgttgctatcggtcagaaagcttctactgtagcacaaatcgttaaaaccctttctgataaaggagctttagcatatactgtaatcgttgcggctaatgcatcagatccggttcctatgcaggtatattctgcgatggcaggtgctgctatcggggaattcttcagagatacaggtagaccagcgcttatcgtttatgatgatttatctaaacaagctgttgcttaccgtgagctttctctactattaagaagaccaccgggccgtgaagcttatcctggagacgttttctatcttcactcaagactattggaaagagctgcaaaagtaattgctgatgataatatcgctaagcaaatgaacgacttgccagaatctcttagaccaatcgtaaaaggtggtggttcattaacagcccttccgattatcgaaactcaggctggtgacgtttctgcatatatccctacaaacgtaatctctattacagacggacagatcttcctggagtctgatctattcaactcaggggttcgtcctgcaattaacgtaggtatctctgtatcaagggtaggaggtaatgctcagatcaaatcaatgaaaaaagtatctggtacattgaaacttgaccaggctcaatataaagaattggaagcgtttgctaagttcggttctgaccttgatgcttctacgctggcagtaatctctaaaggagaaagaaacgtggagcttcttaagcagccggtaaactctccacttcctgtagacagccaggttgcaatgatctatgctggtactgagaacttattgagaaacgttccattgaacaagattaaagaattccaacacgagtatatcgagttccttagatctaagcaccctgatacaatggctgctatcaaatctggaaaaatcgataacgatattacaggtgttcttaagcaggcagctaacgatttagcttctaaatacaactaaaaaattcaatgtttaaggtttaaaatatagcgttttaagccttaaactttagaccttaaactttgaacccaaattaatggcaaacttaaaagaaatacgaggcagaattacgtcaatttcatctacgatgcagattacacgtgctatgaagatggtttccgcagcgaaacttaaaaaagcacaggacgcaatcgtaatgctaagaccttattctgaaaaattacaggagcttatccagaatgtaaattctagctctgatcctgaccaggtttctgtatatgctcagaaaagagaggttaaaagagtacttttcatcgctgttacttcaaacagaggtcttgcgggagcttttaactcttctatcgtaaaggagcttaacattcagttccagaacaacgctcagtatgagattgaagttcttccggtaggtaaaaaagtatatgatgctgtaagaaaaaaccgttcggtttatgctaatggaagttctgtttatgataatctgaactttgatacagttgctcatattactgaaggagtaatgacaagcttcaaagaaggaaagtttgatgaagtttatgttatctataacaaattcgttaatgcagctactcaggaagtaactacagaaaaacttcttccgatctcaatgcctgaaaatacagagccacaggttgaaactgattatatctttgaacctaacagagctgaaatccttgataatttgattccgaaatctatcaaaactcaggttttcaaagcgatcttagattcagtagcatctgagcacggagcgagaatgacagcaatgcacaaagcaacagataatgctcaggctttaaagaatgatcttgtgatcttctacaacaaagcaagacaggcagcaattaccaacgaaatcctggaaattgtttccggagcagaagctttgaaaaattcgtaaagaattattttaacatacaattaaagcaccgatattatcggtgcttttttattttcacaaggctgaaagtgccatttaatacccaaaaaactctttattgatatcataatgagaatatacctcaattattttttttattgagaaaaaccagcatcagatcacttcagatttttctttcaaaaattccttcatcgaaataatctatcccggattcaggttatttttattttacatatctttgtacttaataaaatttatacaacttctaaatggactcggacatagtcaggcttttgctggccttatttcttgttttactaaatggctttttcgtagccgcagaattttcaattgttaaagttcgttattcgcaaattcagttaaaagctgcagaaggaaattctatggctaaacaggcagaacatatcatcaagcatcttgatgaatacctttctgctacacaattaggaattacattggcatctcttgccctgggttgggtaggagaaagtgccctgcatcatattgttgaaaatatttttcattcccttaatatggaaatgagccaggcttccattacttcggtatcactggtgatcagtttcgtattaattaccatcatgcacattgtgtttggtgagcttattccaaaatcaattgcgatcagaaaatctgaagctactaccatggcaacagctgttccactgagaattttctacctgatctttaaaccgtttatctggttgatgaactctatgtcgaatggtttcctgagattaatcaaaatccatccggcttctgaacaggagatccactctacagaagagctccagcttctggtaaaacaaagtgccgatagcggagagattgaagaggaaaactatgagatcatcaaaaatgcatttgattttacagaccattctgccaagcagatcatggtgccgagacagaatattacttccatagactttgaagaagatatcaatgagattatcaacaagattatggacagcggatattcccgtattcctgtatatattgactccattgacaatgtaatcgggattttctataccaaagaaattataagggaatatgtgaaaagaaaaggagatcttgatcatgaagaccttaaagatcttatgagagatgcattctttgtggtagaaagcaaaaaagtttcagatttgttgaaaacctttcagcttaaaaaacagcatattgccattgttattgatgaattcggaggaacagaggggattattacgctggaggatattcttgaagagctggtaggggaaattcaggacgaagaagatgatgaggaaaaaatcgttgataaaatagctgagaatacctattgggtacaggcaactcagcctttggacgaaatcaatgagttcttacctaaaaaactgccgctttctgaagaaagtgaatataattcattagcaggatttattctttatgaactggaagagattcctgaagaaaatcaggagtttgacctggccaactatcattttaaaattctgaagatgaataataaaagtgttgagctggtagagttggtgtatgaagagcccagcactatagataacttagcagacaaaatcggagaagtttaaaacaaaaccgtaacaatgaatttttataacagtataaaagattacgaaaacccaaaacgtcagtatgaagaagaagtccttgttctggatgatacggatgacgtttataaactggtactgcacaatgatgatattcatacctttgattatgtaattgactgcctgatcgaaatatgcaaacatacccttgagcaggctgaacaatgtacgattcttgttcactacaagggtaaatgtaccgtaaaaacaggttcaatggatgttttgaaacctatgcatgaaaaattaatttcgcgcgaattaacaagcgaaatcgtataagataaagtccggtaaattttattaccggacttttttatgaaatctaaagagtaaatttgagtaataacaataaatcataaagactggctggtttcctgaaaatattttaatctttaaaagctttaatcttttaatttctcaacacacttacattgtcatattttatctaaaatagtatatttgtaccaactataaagaaacaaaaaaacaatgcttgtaataggaattgccggtggtacaggatccggcaaaactactgttgttgacaagatacttcagcagcttgatattgagggaatgaatatcctctctcaggataattattatcacgacaaccagggtcttacattgacggaaagagaggctttaaattatgaccatccaaaatcaatagactttgacttactgataaaacatgtaaaagctttaaaaaacaatgagccgattgaacagccgatttacagctttgttacgcattccagaacaggagatcatgtcactgtagaacctaaaaacgtattggtagtagaaggaattcttgttcttaccaacaaagaattactgaaagaatttgatctgaaggtatttgttcatgctgattctgatgaaagattaatcaggagaatcaggagggatacccaggaaaggggaagagatctgagtgaggtattacaccgttatcagaccactttaaagccaatgcaccaggaattcattgagccttctaaaaatgaggccgatctcattatcccgaatatgaagcagaattccgtagcgatagattttttaactactgttattaaaaactcgttgaaaaaacattaaaaaaatggaagaaaacaaccttatcaaagacattcagccgaaatctgaaacattcaaacttattcagaaatatgttttgaacaagtataccattacgatctgtctgtttttggtatggatgatttttttcgataaaacctcatttcttgtgattaacgaactgaatggtgagattcataaatatgaagagcagctggactattataaaaaagagtacgagaaaaatgatgctttttataaaaaactgatgaacaacaaatcagagaaagaaaaatacgcaagagaaaattattttatgaaaaaaccgaatgaagaaatcttcattctggtggtagacagtacaaaagtcgctaagaaataataaagttgaatagagaaattcactattgacaattcacaaataaaaaactaatgtcaaatacagatatactttcaaactgggaaaatttagtcaaaaaacagcttaaaacagaggatatttatcctgttttagagaaacagaatctggaaggaatagaggtgaagcctttttatacaaaagtgcagaagcctttggtaaacctgccacgagttgaagaaagtacccatctggtagcaagataccatgaaagtctggaagaggaagtatttgcatttatattggatcagaatgtagaaaatctggatcagaaaactctttttgtgaataataaagatcttgcagggcatatcagtcctaaagaagaagatcagtatttttcgctgatcgatgtttttaatgaaaaagaaggaaatattgatgatcagctggcaaaagaattactggcaaaaggttttaaaagaagcatctgtgtagacatttcactccaccagaatgcaggagcggcaatttatcagcagcttggtattgctcttgccaaaacaaaagagctggtagaagcatacagtgctgaaattttaaataaactgatcttcagaatagcagtaggaggaaactatttctttgaaatggcaaagctgagagcttttaaaatagtctttaaccagctttccaaagaatacggactggatgaagttccttacatcttcgcagagacttcactgcgaaataaagccgtttcagacaatgaaaacaatctgatccgatctacactggaacttgcttccgcaatgatcggtggagcagacgctgttttctctaacaattatctggtggacagaagtacagataattcagaagaaatttccttcaagcaacagattgttctggcctacgaaagtattatcaatgtatttgaagatgcttctaacggaagttattatgttgaagatatcacccgtcagtttgcagaaaaagcctgggctttatttgttgaaatggaagaagcaggaggatatcttgaattattaaaacagggagttgttcagaaaaagatttatgatcatgctgtggaagagcagcaatggatagaagagggcaaaataaagctgataggagtgaatctataccctaaattagacattaaaaagtctgtcgcagatctttacaacgaaaaagaaataaaggcggtacgctgggctgaaatgtttgaataatgaaagaaaaactgatcgatttatttgaatacacctatcatttcaatgctgaagtgattaaaggtattgctgagaacagagaacttgtagatgataaaacaatcagtctgattaatcatactcttaatgcacagcagatctggaatgccagaatactaggagaaactacttttgaagtatggcagatcaatccatttgagtctctgcaggagattaatcataagaattttcttaaaagtattgatcttatcagtagtcttgatttagataaaaggatagaataccagaactcaagagggacaaaatttgaaaacagtatttttgaaatgctttttcatgcagtcaaccattccacctatcacagaggacaaatcaattctttgcttaagcaaaacgggataactccagtagcggctgattatattttttataaaagataatttgattaataatcattttcgaataagattttgtattctgatacgtaaaatgagacattaagcatctatggaaatcttttatgcggttaagaaggaatgaatacattcaaatatttaaaattacgtaaataaaacacaagcatctgtgaaaatccgtgtcatctgtgattaaattaataaacaaggaaattcaaaactacatcaatgcaaatctgaatacagatttacacacattactgctgaaaaaatctccatttcctgaagtatcgatgcatgaaattgttcagcagatcaaaggaaaacaggttgccgaaagaaaattcccttttctgttgaaagaaggtgtcatttttccaccgcagcttaaccttgagcagtcatcatcagaaaaaactgccctgtacaaatcggcaactttaaaaggaaataagtttattgatctgacaagcggttttggtattgatgcctattatctgtctcaaaactttgacgatattactttaatagagcagaatacagaacttctggacattgttgaacataactggaagattttaggccgccaggcaaaatttatcaacagcagacttgaggatttcctaaacgaaaatcaggaacattttgatgttatttatcttgatccggctagaagagaccagaataaaaacaaagttttccttttggaagatctttccccggatattcttgaaattcatgaaaaattgcaagctgtttccagtctggtagtcattaaactttccccgctcatagatcttaaataccttgtttcagtgctgccgggtattgtaaggattgatattattgccctgaaaaacgatgtgaaagaagtagttgtttttctatccaaagcaaatatgggaaaagttttctgcaattgtgtaaaccttgatagcaatgaagctgcctttacttacacatttggggacgaagaaactgcacaagctgaatactctgagcctgaaaaatacatttatatcccaaataatgccgttttgaaggcaggtgtttttaatttgatttcgcagaaattcggattgaaaaagcttcacccgaatagccatctctacacttccggtgaaaagatagataattttccggggagaatttttgaaatggtaatgattgattctaaaagtattaagaaaaaaggtcagtttaatattatttcaaaaaattaccctttaaaacccgaagaaatcaaaaagaaatatggtttaaaagacggaggagaccagtatcttatttttacacaatccaaaaaaggaaaaattatattaaaatcagtataaaaatgttgccgaaaaaagcaggatttcttacttttgggcaatcaaaaatttaagcatgagatcgcttgctgtttggaagattatacagactgaaaatagtgcggtttcatattacctttaaaaaataattttacatatgaaaaaattagtgatatgtttggcgattgcaacggtggcggtaagctgtaaaaaagttccgcaaggaggaaacagaggtgctttgaaacttgaagaaggagtagaaagatattctgatgatcctcagggtggagctcacgggcatgaagctgctgcagcagagcacaaagaagagactcctgcacaaccggaagctgctgctccgaaaacagacagtactgcggctgcaaaacctgctgaagctgaaaaagctccaaaagctgaacactaattacaagtacaaaatatataattgccctgtttctgcagggcattttttattaaaaagagtgctacagggctcattagcatgacgttgggaaaatcctgcctttttgtttgcccctgccggtcattttttttaattttaacaaaataaatttttacaatgcaagagacattaaattacattaacgaaaacaaacagcgtttcgtggatgaattatttgagttattgagaattccttctatttctgcagatcccgcgtataaagatgacgttttgaaatgtgcagacgtagtggcagcacaccttaaaaatgcaggagctgatcatgttgaagtttgccagaccaaaggatatccaattgttttcggagagaaaattttagataaaaatttaccaacagtactggtatacgggcattatgatgttcagccggcagatccgttggaattatggaccaaaccgccttttgaaccttatattgagaaaacggaattacatcctgaaggagcaatctttgccagaggtgccgcagacgacaaagggcagttcttcatgcatctgaaggcttttgaagccatgatgaaaaccaatgctcttccttgcaacgttaaatttattctggaaggagaagaagaagtaggatctgtaagcttaggcgactgggtaaatgaaaataaagagaaattagcctgcgattgtatcctgatttccgatacacatatttacagcaacgaacaaccgactgttacaacagggttaagaggattaagctacgtagaagtagaagtggaaggtccaaacagagacctgcattcagggctttatggaggagcggttccaaatccaatccacgttctttcaagaatgatcgctgatctgattgatgaaaacggtcatatcaccattgacggattctacgacaatgtagaaacggtttcagatgcagagagagctgaaatgaacaaactgaaagataatccggaagaattcaaaaaatcaatcggattaagcaatattgaaggggaaaaaggctatacaactttagaaagaacatctatccgtcctacgttagactgcaacggaatctggggtggttatacaggagaaggtgcaaaaacagtaattccttcaaaagcttttgctaaaatttcaatgcgtttggttccttaccagactccgcaggagatcacggaaaaattcactaaatattttgaaaaaatcgctccggatacagtaaaagttaaagtaactcctcaccacggaggaatgccatatgttttaccaacgaataccaaagagtttgctgcagcaaagcaggcaatggaatctgcattcggaaaagaggtgcttccatacagaggaggaggaagtattccgattacagcgatgttcgaacaggttttaggcgctaaatctgtattaatgggattcggattggattctgacgcaattcactctccaaacgagcattacggactattcaacttctataaaggaattgaaagtatcccgttattttttgagaattattcaaaataattgaacaaaaataatatatgataaggtatttctgagaagagataccttattttttgttttattttctatcataaaatacatttagaagcatatttttaaagggctgaaaaattaaattccctgataataaaagcgttattttttatttgcaataagttatttcaccattcatggaaagtttatatttttaatacaaaacttgaactactatgaaaaaatactactcaattgcactgttgatatcatcagtttgcatttttgcacagcagtccatatcctttgagtctactgaaggattcaacgctggagatatcaacggacaggcaggatggatcagtactcccaccggaggagttccccaaaatgtaacccatcagaccatcagcatggataaggcaagtgatggaaacagttccctgaaaattgtcaaagaaaatacctacggaatccagagtgctcccattatcggagggttttacaacttgccgacacctcttgcctacaacaatttttctatatcattcgatattaatatgtcacaacttaatggctctgattttggttttcagggagtaaatgatatggatgatcagtttgtaatgagattggattttgaaaaaaacggattggtaaagctcctgaatatggtatccggtatacagaacctgattactgtttcttcaacctggctgcctaatagctggtatcatttaaaagtaatagggaccgccacagatgtcagatattaccttaatgatctgttgatttataccggcccggcagcaagctctctacctataaaccagcttcgttttgtacacaataatgcattgggttctgcctatattgataacattaaaatcaataatcaggcaactctatctacaaaagatccggttaaaaatgaggtgagattatcggtttatccaaacccggctactgagtttataaagatcacaacttctcaaaaaataaggcatattgaagtatatgacctgtcaggaaaaaaaatagatgtaccggtgaatggagagcaggtatatgtgaaaaatctgccttccggaacttatttactgaatgtggaaacagatggaagaaattttacagagaagttcatcaaagaataaatcctgataaatcttagtatcagcaaaacgccccaattggagcgtttttgttattttagagaattaaaaattaaccatatgtcagaaaataaaacagcttatataacaggaggaaccaaaggaataggtttcggaattgcgaaaatattacttgaaaacggaatctctgtcgcattttcaggaagaaaaagggaagatgtgatgaaggcggaagaagagctcagacagtattcacaaaatgtattgggaattgtttctgatgtaagaaacctggaaagtgaacaggaagcggtaaaatatacgattgaaaaattcggaaggctggattatgtggttgcgaatgcaggattggggatttttaagcccgtagatgagcttaccgccgaggaatggaacgatatgatagaaaccaatctcacgggtgtattttataccttaaaagcctctgtggaagaacttaaaaagacagaaggttattatattaccatctccagtctcgcaggtgccaatttttttgaaaacggaacaggatacaacgcatcgaaattcggggtagtagggtttacgcaggctgcaatgattgatttaagaaaatacaatattaaatctacagtgattatgccggggtctgtagcaactcacttcaatggaaacgttccttcagaaaaggacagttggaagattcagcctgaagatatggggaatctcgtattggatattctgaagatgaatccaagagttttgccaagtaaaatagagtttagggcaacaaaaccagcgaagtaactacatctaatgtattgaataataatttaataagtattatgcatgcataatatattttttatttatattagcaaaaattaattcagacaaaatctctgcataaaccatcatgattttatgcttcaaagagaaaaataaaaatagtacacgtgaaaccctaaggttacatatgaccaataaaaaaattaagaacaacatatgaaaatattagtttgcattagtagtgttccggatactacttccaaaattaactttacagcagataaatctgctttcgacaaaaacggaattcagtgggtaatcaatcctctagacgaatttgcgttgacaaaagcggttaaacttcaggaatcccagggagcaacagtaacagtaatcaacgtaggagatactgctacagaacctgttatcagaaaagctttggcaattggtgctaacgatgcagtaagagtaaatcttgatccgaaagacagctattctacagcaaaagaaattgcagctgtggcgcaaaacggaggatatgatcttatcctttgcggaaaagaatctatcgattataacggaggttctgttccgggaatggtagctcagttattgaaccagcctttcgtaaacgcttctgtaggattagacgtaaacggaagtgaagctacagcagtaagagaaattgaaggaggaaaagaaactatttcagtaaaattaccggcagttattgcaggtcagaaaggattggtagatgagaaagatcttatcatcccgaatatgagaggaattatgtctgcaagaacaaaaccattgcaggtagtagaaccttcttcttcagaagtaaaagttcagggtgtatcttatgacagtgttccgccaagagcagctgtgaaaatggtttctcctgacaatctggatgaattggtaagattacttcacgaagaagctaaagtaatctaatctttaaatttttcaatctttaaattttaaatgtaaaacaatggcagtattcgtatacgcagaaaatataaacggagtttacaaaaaagcggctttcgaagcagtttcttacgctaaagctatcgctgataaggcaggagataccgttacggcaatctctgtaaacccaactgactcttcagatttattatacaaatatggagcgtcaaacgtaatcaatatcaaagacgaaggtcttaagaacttctcagcaaaagcatttgcacaggcggtaagcgaagtggcagacggaaatatcatcgttttccctcacactactgatgcttcttctgttgctcctatgcttgctgtgatgaaaaactattctttaatcactaacgcattggaagctcctgaaaacctttctcctttccaggtaaaaagaagagcattctcaggaaaaggtttcatgcatgctaaagctgaaggaaacggagtaatcgttacggtttctcaaaatgctttcggtgttaaagaaaatgcagtatcaggttcagaagaagtgaaaaacctatctgtagcgaatgaagataccaaagtgatctctcacgagcagagctcaggtaaattagaccttaaagaagctgaaatcgttgtttctgccggtagaggaatgaaaggtcctgaaaactggggaatgatcgaagatctggcaaacgttttaggagctgctacagcatgttctaagcctgtttctgatatcggatggagacctcacacagagcacgtagggcaaacaggtaaagcgatttcaccaaacctttacatcgctgtagggatttccggagctatccagcaccttgcaggggttaactcttcaaaaacaatcgtagtaatcaacagtgatcctgaagcaccattcttcaagtctgctgattatggagttgtaggagatgctttccagattattcctgcattaacagagaaaattaaagcaattaaaggataagaaagtgaatagtgaatagtcgcttgcttttcaatttttaattaaataattcactcgcaaagcaaaattcactattgacgtttgaccatcatcaacaatacaataaaagctcggctttccgggcttttatttttgcgtaaaaaagtgaaaacacaacaaaaaattaatctatatttgtagctatggattataaacagctaattattcgcggaatatcgtacagccagactcaatcaggcgcgtacgcattgttactggagcatgaagaaacacacataaaattacctgttgttataggaaacttcgaagcccagtctatctctctaggattggaaaaagatattcatccgccgcgtcctcttacccatgatttattcacaaaatttatagtctctgccaattatgagttggtttctgtcattatctatcagattgtagacggagtattcttctccaatatcaactttaaaaataaagtgacggatgaagaactgatccttgatgccagaacttctgatgctgttgcgatggctgtaagattcgatgcgccgatatttacaacccaacaggttttaaatgaagccggaattttactggaacttgaagacgtatcaaaagaagaccagtctttctcagaaactgtacagacagaagataacttaaaatctctttctatggaggagcttcagaaactattggatgaagccgtgaaagaagaagactatgatactgcccttgagattcaggaagaaatcaagaggaggaaaaagaaaattgattaaagagatactttttatataaactatgaatttaaaattacgactgactgtcctgaattttcttcagtttgcagtttggggagcttacttaacttctatgggaaattatttaggttctataggattaggctccaaaataggacttttctatgcaatgcagggaattgtttctatttttatgcctgcaattatgggaattattgcagatcgttggatccaggcgcaaagacttcttgggatctgtcatttacttgctgcgggatttttaattgctgcaggatattatgggatgtcagcaggaaacaatgttgagtttcccaaattatttactttgtatagtttgagtgtgatgttctatatgccttcaattgcattgtcaaactctgtagcctatacaattcttgttaataataatttcgatacaattaaagctttcccaccaattcgtacttttggaacgattgggtttatctgtgcaatgttatttgtagattttacgagttatcagaataattattcacagttttttgtttctggtattttaggaattattttattcctgtattcatttacgttgcctgcatgtcctgttaataaaagcaatgaaaaaagaagcttatatgatgctttaggattaaaagcttttagtttgtttaaagataaaaaaatggcaacattctttatcttttcaatgttattgggagtttcccttcagattactaatggttatgcaaatccgtttataacaagttttaaagatattccttcttttaaagaaacatggggagctaatcatgctaatgcattgatttccttgtcccaggtttctgaaacagcatgtattttgttaattccattcttcttaaaaagattcggaattaaaaaagtaatgctaatggccatgttcgcatgggttttaagattcggattatttggatttggaaatcctggtggtggtgtatggatgtttattctgtccatgatcgtctatggtattgcattcgatttcttcaatgtatcaggttccctctttgtggataaagaaacagataagagtatacgatcaagtgcacaaggagtttttatgatgatgacaaacggtttcggtgcaacaattggaatgcttctagcacaggagattgtaaaccattatgtattttctcaaaccgatcctttgctgcaactaaaaggatgggaaatgtcctggtatatttttgcaggatatgctttagtcgttgcagtattgtttgcttttattttcaaacacaagcacaatccgaaagatgtttcatccgtaaaacattaattgaaactcacattttattaagatattaaattgcattttgaaaaaaatgcaatttttttatttaaagatggttatgcgaattaaatctgcttttttcataaggactttacttctgcttttactaataatgcttactgaacaaaaaatatggtcttcagataggaatagaaatagcaagtgttgattttaaatttaataataaattcattttttctttacataataattaaaaatatcaaatattttttatgtctaacaagtgttcgggtgccaaacttctatttttaaaacacactatttaaaagtgtgtttttttttgtattttggcactttagtaaatatgaaaaatattcagttattaggtttaattttagtcatcgtaggcagctttttacctttggtacatgtgcctgtcatcggaaactggaactattggaagcttgatcattatctggctattatctgctggattttttctgcttgtgcggtttttggaattgtaaataacagtgccggagttgttagattttttggtattctgcttattcttttattcggatttacattagttgctgtgaaaatgcagtcgcttcaatactttagctttttaccattcaaatcatggcaggaaacttttgcgggaattgttaggttaaaatggggatgggctgtagaattttcaggtgctttgatgatgatttttgcaggaagaaataaaaaagtaaacaatagaacacaaatataaaaatgaatttcttaaaaatattttcagcaggaattttgctgacagcagctattcagatagaggcccaggcaacaggacagaaaaagccggataatccgcctaagtgtgctaatattaaggaagggaagttcgtaagacccaattatccggaagggatatggcatatgaccattaaggataatattcagactgaatatttgaataatggaaaagattatatcaaatcgacactggtttttgtggatgattgcaattacaaggcaatcgtgatggaaaaatcagataaaaatgatcccgcacagataggagatgttttcaataataaaattgtagccactcaggacaaccttctgaaagtgaatactaaaattgaaggaactcaatttgatgtggtgtacgtaaaagtaaaataaattcaaactataaaaagggattaagttcccttagctaaaataaaaattatatacatgaaagaagtattcattgtttccgcagtaagaacacctatggggagttttatgggaagcttatcaacagttccggctacaaaactgggagcaactgccgtaaaaggagcattagataaaatcggtttagatcctaataatgttcaggaaatctatatggggaatgttcttcaggcaggggaaggccaggcgccggctcgtcaggttgctttaggagcaggtctttcaatcaatacaccatctactacagtaaataaagtttgtgcttcaggaatgaaggctgtaacaatggctgctcaggccatcaaagctggtgatgcagatgtaattgttgcaggaggtatggagaatatgtctttggttcctcactattataatgcaagagtggccacaaaattaggcgatatcaaaatgcttgacggaatggtacttgacggtcttacagatgtatataacaaagtacatatgggtgtatgtgcagaaaaatgtgctgcagactataacattacaagagaagatcaggataacttcgctatagaatcttacaaaagatctgcaaaagcatggagcgaaggaaaattcaatgaagaaattgtaccggtttctattcctcagagaaaaggagaaccagtaatctttgctgaagatgaagaatacaaagcagtaaacttcgacagaatttcaacacttcctaccgtattcaaaaaagaagaaggtacagtaaccgcagcaaatgcatctactttgaatgacggagcttctgcattaatccttgtttccaaagaaaaaatggaagaatttggactgaagcctcttgcaaaaatcatttcttatgctgatgcagctcaggagcctgaaaactttacaactgctccggcaaaagctctacctatcgctcttaaaaaagcaggattggagatttcagatatcgatttctttgaattcaacgaagcgttctctgtagtaggattggcaaacaataaaatcttaggattggatgctgccaaagtaaacgtaaacggaggtgctgtagcattaggacatccactgggaagttcaggctcaagaatcattgtaactttaattaacgtattgaagcaaaataatgcaaaatacggtgctgcagcaatctgcaacggtggtggaggtgcttctgctatcgtgattgaaaatatctaatattctgtttcagaatatattgccattaaggaatcgataatttttttaaaaacttatccatttcttaatggtttttttatttttgtgctactaatatttatttgaaatgtctgaaactgagaatcgacagcctaaaaacataaagaataatccgaagattatgaaggcctgggctgtatatgactgggcaaactccgtgtattccctggttattacctctaccatttttcccatttattattctatccttaccactgcttatgagaagaaagaatatgtagcagaaacaaaatcctggattgatgttccggtaaggcatacgattaaaatttttggagaaggttaccagccggatgctgtatacgggtattcacttaccatatcgttttttgttgtggttttgttgtcaccgtttttatcttctttggcagataccatcggaaacaaaaaatcttttttgcagttcttctgctacctgggagcaacttcatgtatgggattggctatgtttacaggaatgcataatgtctttctggggcttctgttcagtattacggccagtgtcgggttctggggaagtctggtgttttataactcgttccttcctgatattgccacaccggacaggcaggatgcactttctgcaagaggatatgtttacggatatatcggctctgtagtattagtggtgatctgtttggtactgattcaggtttttgccaaaggagctgcgcagcaactactgtttacaagaatcagcttcctgcttacaggagcatggtggttcgggttctctcaatatactttcaaacaccttcctcagtttggggatgtaaaagataagcttcctaaagatcttgtattattgaactataaaaatatctttaaaaagcacgaagagcagggaggctttttcgaagtactgaaagataatcttagcttttataaagacattgcaaaagaaagtttccatgaactgttcaaagtaggcggagagcttttcaaagacagaaatctgaaattcttcctgtcaagtttcttcttttacagcgtaggaatgcagactattttcctgatggcaaccttatttgggaaaagtgaaatcaacctggctcaggataaactgatcggaacgcttttggtcatccagattgaagcgattatcggagctgttattttctcaagattatctaagagaatcggtaataaaaatgttatttcaattgctatcatactttggattatagcatgtatatgggcctatttccttaacaaagaaaatcctacggtagagtaccagttctatggcgtagctgcagtggtaggccttgtaatgggtggacttcaggcgatgtcaagatctacatactcaaagctgcttcctgaagactccatggaaaatacaaccttcttcagcttctatgacgtgttggagaaaattgccatcattattggaacatttatctttgcaacactgattgagcattttaataatatgcgtattgcagctttatcaatgactgtattttttggcgcaggattaattttaatacgattcctaaaggttaaaatgagaaaagacagagaaacattataaaattgaaagacgttattttaacgtcttttttattgtattttatttttaaaattatgtttatttattatatttatttcgtaattttattaaaagaactgacgaaagtaaaatagaaaacaattcggcctgagttttgcttatattcagcggaataattttaactttgcaaaaagatttattgtcaaaatgaccaaccctttattttatgcaaaaataatcctgtttggagaatatggaatgattgaagattcccaggggcttgtagtaccttacagcttctataaagggactctgaaatattctgatttaagttctgaatttgagcttaattccaacaggcatctgcagaaatattctgattttcttacaaaacttgatctttccgacgattttaaactggatattgagagtttcaaaaaagatatttcaaacggacttttctttgattccaatattccgcaaggatatggagtgggaagttccggagcgctggtagctgctatttttgaaaaatattcaatcagtaaacttaatcctgagaacatttccaaagataatcttaaaaaattaaaagctgtttttggtgaaatggaaagctatttccatggaaaaagttcaggaatggatccactgatctgttatatgaatctgccgattcttatcgaaaataaagaaaatttagacagggtaaatattcccgagggagaagaaggaaaaggagctatattcctgattgattccggtatgacaggagaaacagggcctatgattcagattttctttgaaaaaatgaaaacagaaggtttccgtaaaaccctgaaagaagagttcatccgttacaacaacgcatgcatcgaatctttccttaaaaaagacatgaacccattcttcagaaatcttaaaaagctttctcactgggcttatgaacatttccgtcctatgattcctgaaagtatctttaacatatggaaaaaaggactggattctaacgcttattatctgaaactctgcggaagcggtggaggaggctatatcttaggatttaccaaagactatgcaaaagcagaaaaaatgcttgaaggcttccagaaagaagtgatctacagattttaaacagcctggaatgaattctgaaaaagaacctttccaatctaaagactatctctcaaaatctctattttacagattttcacaatttgtgggctttttgctcggagcacgtttttttgtagctgccctgctgacatttgccctctatgtttccacttttttcctgttcaatcaggatgaatctttcagaaatttcgtatttgatttcaaagtgcacggtattattttttgtaccgtccttaccattttagctggtggtatcatcaaccagttctatgatctggagaaagaccatttagtaaaacccttcagaaccaggcttcagagttttatcaaacaaaaatattttctgtatgcctacctggcgttgagcgctgtttctttggggattgcctggatgatttcccataatgtttttgttttttttgtaatctaccagttttttatgtggttttacagccataaactgagcagaatattgatactgaataaccttacttttgtcagtctcacgctgtatccgttctttggaatgatggtatattacgaaaccttttccaaaaaggtattcctgatggctgtttttcttttccttattctgttatgtattgatattgtaaaagatacccttacccgaagtgtagataaagcattcggatatactaccatccctaattattttaaaaccagaaatacaaaaatcattctgacctcattattgataattaccatggtggtttctatgaagattattacaaaaaccggtattacaggattcatggcctattattttgccggtggtctttttgtcatgatcgtatgtatttatctccttataaatgcttcccggagaagtaacttctttacattgaatatattacggttctgggtttttataggaatcatagcaatgcttttaaacggaatagagcataaattataaaaaaattcttttaaataaactgaggttattattacctttgcataactaaatttaataaataggaatgcccatttttaatgatactaaaattgcatttgcagacaagtctgatgcacaattgagaaaggcttactggatgtttaaaatgattgaacagcccgctcttacaagccttggaacatctgttctgaatttcacagtacataacaattttcctttcgttacaggaattgtaaaaaacaccttatttgagcagttctgcggtggtgaaacccgtgaagaaagtatgaaagttgtgaagcagcttttcaaaagaggagttggaagtattttcgattactctattgaaggaaaagaagatgaggaaacttttgatgcagtttgcaaagaaattaaggacattgtaagattctcagtaggaaatccggcgattccttttattgtatttaagcctaccgctttcggaagaattgatctttatgaagctgttggaaaaggggcagagcttacaacaagccagaaagaagaatgggaaagagtggtgagaagatttgatgaaatatgtagtctttgccatgagaatgataaaaaagtaatggtagatgctgaagaaacctggatgcaggacgcagcagaccacctttgtgaagagatgatggagaaatacaaccagcagaagcctatcgtttggaataccatccagatgtacagaaccggaaggctggaatatatggaagctcaccttcagagagcgagagagaaaaattacttcatcggttataaaatcgttcgtggtgcttatatggaaaaagaaagagccagagcagcagaaaaaggatatgcagatccaatacagccaaccaaagacgcttcagataaaaattataatgcaggaatcgactttgtaatggagcatctggataaggtttcagcgtttttcgggacccataatgagatctcttcggaactgattatggacaaaatgaaggcaaaatctctggaaagcggtaatccgcatgtctatttcggacagctttacgggatgagtgataatatcaccttctatttgtcagataaaggctataatgtggctaaatatcttccgtacggacctgtaaaggatgttgtgccttatctgacgagaagagcccaggaaaatacctctgtggccggacaaaccggaagagagcttggactgatcaaaaaagaactggaaagaagaaagaaacaagcgtagtattgttctcaataaatcaatcagacccgcatttttgcgggtcttttttattggttatatcttaattgctgaaccaaaaatggaattttatttgaatttaaaaataactaatctatttactatttaaatcgattatatataaaataattttatttttattgctgatttgattttaaatatttatatttgataaagacataaaaactagcacatggaaatgtttttcactgactgtgataagtcttatggacattttgcccatatgatagccacagtaattatccacctaaaaaaccggcattataaaattataaataggaacagatgattattagataaattcgattaaatgataccctgtcaaaaatttttaaaaataaaataaagcaatagctttagttttcttcttcaaatattttttaacctgatcatttctctgatcaggtttttttttaaggctcaaaactttcgaattttccattttcataaaacaaaacaatacgttttattttactttgctgattaccaaatagttgtcctaaaatctgatcaccagaattttctaatcgctgagaatccgatattttttccggagctttatcattggccgttataaccgattctccagcacttacttttggagtttcagcttccgtttcttcgcttccgaattcatcatcatcattcatcatcgtaaaaagatcgggtagtggagttgtttttattttctcctcttcggtatgttcttctttaatttctgtttctggcaattgcgatttcagcatttctccttcgcccgtaaccagccaatcccatagaagttccgggaaacgggattttatttttatgataaattcaagagacggtttgtttcttcctgatgtgatatgtgaaatggacgaacgctgtacatcaatctcatcagcaaactcggaaggagtaagattggaatactctataatttttgaaattctttcatttaaactcataaaaataagcctttaattattttacaaatgtaatatttataatttacaaatgcaaaatacaaatgtaaataaatgtgtaatttaattatatacatttgtaaatagaattcaaaacgctttaaaacaaggattcatagataaattacaattgtatttaattttaaaatcatttctgatgaggcttattgattaaaccttacatttattgaaaaacaagtttaatattgtaaattcacttcattttgctctgtatttttactgttaaagctcctaaaatctactgtttacattgttaatatcctgtatttccatttctttagtccaattagcttaattccttgttatatgccattaaaagccatattgaaaccatatacaaaagtaaaatataccgattttatactaaataaacatcaaattgggagaaataatcttaaccttaaaccacttaattttctaaacattaaaatgcctgcgaaaagcctataaaaaataaaaatatttcacggaaactcttatttttattgtgtttacatttgtatatgaaaatagatgtctaagttttccacaattaagatgtttaaaaaaataatgctcaactggccttaaaaagcattatatttacttcaagtatagttataaatgcaatttaaataagttttataacttactgaatataaatattttaaatatatgtaattaaattattcgcaatccacatttttatccacagacaatttgtccatcagtactgtttaacaatgttacaaaagttaacttgattacttaactcaaaattaatgtggattaaatcttgtaaatttattttaaaccacaatgtcaaatgtaaattcaatcattttactgatttttacaaatgttaatttaaattttagcccaaaaatggctaaatttgattcctgtaaattatttcgcaaaatgaattttgaacagatctactctcagaaccccgatttctcaaatcgctatatttctcctgaaaaattattttcttatctacaggcaaatctcagcgattacattcagcagataggaacatcctatttagataagccgatttatcagttaagcatcgggaccggaaacattcaggtgctggcctggtcacaaatgcacggcaatgaatccaatgctacgcacgctatgcttgatcttttggaaagccttaataaagctccggaaatgaaagaggatttattcagtaaaataaaacttgattttatattcatgctgaatcctgacggatctgaaagatggaccagactgaatgcagcggatattgatctgaacagagattttcataacgaagcaagtaaagagatcaaattcctgaaaaaagcagctgcttccaaaaaatatgattatgctttaaaccttcatgaacagagaaccatttttaccactgatggtattcatcctgctacactttcctttttagctccgtccgaaaatgtagagcgtaccgtgactgaaaatagaaaaaaatgtatggcagttatcggaagcgtatacaaccatttgaaagaaatgattcctaatcagatcggaagatattctgatgaattctatccgacttctacaggagacaatttcattaaagcgggaatgccgactattttatttgaaggtggacactttgtggatgattataccagaaaaggaaccagaaaatattatacaattgccctttattatgccctgaaggcaatcagtgaactcaactctgatattacaggctgggaaacatacctcgaaattcctgagaacagggaaacccactatgatattatttacaggaatgtaaaattaaatactgaccatgaatgtattctggatattgcagttcaatacagggaaatcaaagaggaaggaaaagatgatatttcttttatcccttttgtaatggaagccggggatgtaaaacaaaagaaaggttggttggaaatagactgtaccggcaagaaatttatttctgcaactaaatatccaaaactggattctgtagtggattttaaaattgaagactaaaagaattttaaataacctcataaaaaatctccggcagcctgaagggctgccagagattttatttttataactaaattccaaacttgagatattaaaatttatattcaataggaatgggcattagcccatttacattaaataaagattcatccggctttagccaaaacttaatttcagaatataaagtttagttaaccactttaattccatttgctacaaatctgatttcttctttaggctgggtaatcgcatcaatttcagactgaggttttttagcatcttccgcataatgtttctgctcatttacagaagttacttttctctcagcattcccttccaatactacatttttcccttttaaagcggtaggaacgaagaacgcataatctttcattttcacaaaaaacttagaattgtcttccgtctgtatggtaagccagcagccttttttgtcgcagacatcggttaccttgcctttaacagcaacattctccacttttttattgtcttttttgagctttttgttcaatttatctactgtgatcgctttggattctgcggatgaacttacctgagctccataaatatcacctaccaaagcttttccttccggaggaccggattgggcaaatgttaatgaagaagctgttaatgctacacaaaataatattgttttgaatttcatgttaaaaatttttccaaaaatactaattaaaattgaatcataacgaaataaaaaatggtaaaaagcagttgtttttaaggaattttcaacaaatttgaaaatcaacggcagatttgattatatttgaatcctatacttgactatgcagaaaaaactgaaactatgggatgccatcatgctggtgatgggatcgatgattggaagcgggatctttattgtaagtgctgatatgatgcgaaatctgggaacaggattttgggtgattatcgtatgggtgattacaggaattatgacggtagcagcagcaataagctacggtgaactgtctgccctgtttcccaaggccggaggacaatacacttatctgaaagagattttcggaaaaaaaatgggcttcctttacggatggggtctgtttacggtaatacaaaccggaactattgcagcagtggcaatggcttttggaaaatttaccgcttatttagttccgtcattgaatgatgccgcaccaatatttcaaagtggtgaatttaaaattacatggatccagattctggcgattggagtgattttattgcttacctatattaacacccggggagtagaaagtggtaaaatccttcagaatatctttacgggttccaaaattatagcattattaggcttaattgccgccggttttattctggtagacatttctcatttgtcagaaaacttcagttggggaacagattcttttaataatcttaaaaaagatctgagtggtaatttcctgaaggaaggttgggaaccaatcggaggaatgactcttcttgggggaattgctgctgccatggtaggttctgttttcagttctgttgcctgggaaagtgtgacctttgtttccggtgaaattgaaaatcctaaaaaaaatgtagtaaaatcgatgatttacggtacttctgctgtgatgattctttatattgctgtaaactatgtctatctgaatgcgcttgacagggatagcattgcatttgcagctaatgacagggtagcggtagcagcctctcagaatatatttggaagtgcgggaaccattattattgccttattggtaatgatctccacatttggatgcaataacggactcattctggcaggagccagagttttccagacgatggcaaaagacggtatgttctttaaatcggcagtacaaaacaacaaaaatgaagttcctgaaaatgcactttggatgcagggagtttgggcttccattttatgcctgagcgggcagtacggaaatttattggatatgatctctttcgtaatcgtccttttctatatgattacggtttttggagttatttatttaagaatgaaacagccggatctggaaagaccttataagacatggctttatccggtaacgcctgttatttaccttttgataggaacctgtttttgtatcttattgctaatttacaaacagcaatatacatggcctggttttatactggtattgctcgggcttccagtgtattattttatcaaccgtaaaaaggcagatcagtaaaatatagtacagaagataagagatatagaatattcagggctttcaattcaggttgaaggcccttttttttcaataatattttaaagtattgtagcctttatttgccgaaaatgcgtattttggtatttcgtttttaaacaggaccatgaagtaaaaacaataagttatggatacaccaaattacagaatgcctttcgtaccgtctactttaatgaccgaaggcggaagtatcgatacctgcgatatgggggaaagtattgcccacaatattatgctgctgatcaccactaaaaaaggggagaacagatatgatgaaaactatggaaacgatgtctggaaccttgaatttgataatggagttacaagcgccatctgggaaagcgtttttatcaaaagcttaagaaggcagattcaggaatatgaaccaagaatcgtgaacccgcagattgatgcccatatacagtttgtagagcacagctacgatactaaagaacacaccgaaattaaaaagaaagtaagaattgccatcaatgcaaaaatggaagaaacaggagaacgtttcagtttctcgacggaactgtttctaagtccaatgtctattgattaatatttttaacagcgaaagaaaattatgaatttagatcagaatatttattccaaagaatctgtaaaagcaagaatgctgcagaatgcaactaaagtatggggattgagaagcccgcagtctttagatccgtttgtaaaactgctgatagatgcattcagtacagaagttttcaaagcgaataatgaaatacagacagtaaatgcccgcatattggaaaagctggcaaaactgcttacaccttctatttacacacatcctatcccggctcattccgtggcttttacacaaccttatgagtcttctgaaattttactggaacatacggaattcttcttccgtaaacagatgacatccactgtaaaatcagagtcagacaaacagctgaacattccttttactcctgtaggaaatgtgagaatcaataaagttcacacgtctatcatgtttgtaggaaatacctgttacagcattgatgaccgattcaataaaattcctatttcaagatttcagggcagacctgaagattacagaaaaatcacaataggagtagatgtcagtaaatatgtgagtgagaactttccgaaatatctgagcattttctgctccaatccggcttttgagcatcttgattttgtatacaaattactaccttatatcacagtttcaagcaacggtaatccattatttgtaagagaaggattaagctatctcacggaaagtcattcggatggctacgaacagatgttcaaagagcagtccatcagaaataaggtgattgaagatattaaaagcatttaccgtcataaatttattgaagtaacaggaatctcccaaagcctgttttcagaaccaggagagcttccgcagaaccttgatttcctgacaggaaaagaagaaatcactaaatttctggataataaacgttatctgtggcttacttttgagtttccaccacaattttcagcagaaatccttgacaatttttcctttgttctgaatgctttcccgatatacaacagaggctggaaaaagacagaatacagccttgatatcatggggaataatattcctttggtaaccgatgaaggggagcacttcctgtatgtagatgaagtacaggacggtgacggaaggaaatatactgaaatccctttcacgccggctgatgatctcaaaaaagggttatacactgtaagaaagggaggtatggaacgcttcaccagcagaaatgccgttgatatgattgccaatgttctggaactaacaagggatgaaattgccgcattttcccttttgaacagagacaatgtaaaaggagttctcagcgaaatgtccgataaaatgaaatccatggtgcagaaagtcaacaatgccaaaaggaatatcagacaggaattgaactacgtgatcatggaacctgtagaaaaaacagaccatacttatgcctctttttgggtaacacactgcactctggccaatcatatgcgcccgggaactgaactttccaaccagttgaagtcacaaaccgttgtgctgcttaccgaaactttagggggagctgaagaacagaaaggtactgacagtatccaggcctataaatacgcgctgacaaccagagataaaattatttctttggaagatgttaaaaattactgccgtatgattctgaaagatgaggtaaaagaagtaagggtaagaagggggacaatgatcagcaacaaaccaaaagaaggtttcgtaagaaccgttgaggtagagattgttcctcagaattattccttttatggaagagcctattgggaaaatatggccaatatcatcagaaaccaaatcatagccaaggccatcgacggaattgaatatatcgtaaggattactaatgaagatgttgacttccaggatatgtaatctttaaagaaaattaaatcagtttaaaatataaatgccgtatgaattactgcatttttgaatgatatcaatagaaacgggctttagcccgttttttaatagataatattctccaatgacttttgtcaaaacatataaatcgttctgtagaaattcaacaatttcttatttactccattaacaaaaactaagaattttttatgaaacttttatcccttttatattcaaaaaaagtctataaaatttcgtatttttgcacgttgtgattttctggcaaagtcaccccaaattatgagtaaatcaacagaatatatagaagtttacggggcacgtgaacataaccttaaaaatattaacgtaaaaattccgcgcaacgaattggtcgtgattaccggcctttccggaagtggaaaatcatcattggcttttgataccatttttgcagaaggccagcgtcgttatattgaaacattctctgcttatgcacgccagtttctgggcggattggagcgtcctgatgtagacaaaattgaaggactttctcccgttatagccattgagcagaagaccaccaataaaaatccgcgttctaccgtaggaacggttaccgagttgtatgactttctgcgcctactgtatgcaagagtttcggatgcttactctctgtctacaggacagaaattggtgagttataccgaagagcagattctggaaaccatcaaagaaaattataaaaaggagaagatcatgcttttggcaccagtggtgcgttccagaaaagggcattatcatgaactctttgttcagatggctaaaaaaggatacggacaggcaagaattgacggtgagctgcaggatattgaatatgatttaaaacttgaccgttataaaacccacgatattgatattgtcattgaccgttggatcatcggggaaaatgcctcagaaagcagaatggaaaaatcgttgcgtaccgcaatggaaatgggagaaggaattatcggtatccagaagctgggaagtacagatattgagtacttttccaaaaacctgatggatgcagaaaccggacactctctggcactgcctgaaccgaatactttttcattcaactcaccgaaaggaagctgcccaaactgcaaagggttaggcaccatcaaaaagatcaatacagattatttcgtagataatccaaaactatccattaatcagggaggattattaccattggaagatatcaaatctaacaaatggatactgtcacagattaaaaacatccttgagattttcggattgggattaacaacacctttaaaagatattccggaagaagcactggattatatctacaacggatgtcataaagagtttaataaagatctgaaatacgccggaattaccaaaaaaataaaaataggtttcgatggtctgattgctttcatggaggagattattgatgatagagactcatatgaagctgttttattggaaagacattttacgacagaagaaacctgcccggaatgtcatggcacccgccttcagccttcaagtttaagttttaaaattgatggaaaaaatattgctgaagtcaatgctttaagcttagcggatttaaaagactggctggccgatgttaaagataaattctcagaaaaaaataaaatcattgctcatgagatcttaaaagaaatcgaaaccaggcttcagtttttgctggatgtagggttggattatttaagtctgagcagaagttcaaaaactctttcaggaggagaatcgcaaagaatccgtctggcaacacagatcggatctcagctggtgaatgttttatatatccttgatgaaccaagcatcggacttcaccagagagataatgaaaggctgatcaactccctgaaaaacctcagagatatcggaaattctgtattggttgtagagcatgacaaagacatgattctggaagctgatgaggtgctggatattggtcctaaagccggaaaattcggtggagagattctttggcaggggaaacccaaggatttggttaaagcagataccatcacggctcaatatatcaatggtaaaagaaagattgaaattcctgcagtaagaagagcaggaagcggtaaaaatattgtattaaaaggagctacaggaaacaatcttaaaaatgtaaccctggatattcctcttggaaaactggttgtagtaaccggaatttcaggaagcggaaaatcttctctgattaatggaactttgtatccaatccttaacaaacatttctacagagcggttcaggagccgttaccttacaaaaaaattgaaggattagagaatattgataaaattgtagacgtagatcagacaccaattggaagaactccacgttcaaacccggcaacttatacaggaatgtttacagacatccgcaacctttttgccgaactgccggaaagtaaaatccggggatataaaccgggaagattctctttcaacgtgaaaggcggaagatgcgaaacctgtcagggtggaggattgaaggtaattgaaatgaatttccttccggacgtttatgttcattgcgaaacatgtaacggtaaacgcttcaacagggaaactctggaagtccgttacaaaggaaaatcaatttctgatgtgctggatatgacgattgatgaagcggtagatttcttccagccgattcctaagattttttcaaaagtgaaaacattgcaggatgtaggattaggatatattacccttggacagcagtcgacaaccctttcagggggtgaagcacagcgtatcaagctggcaaccgaactggcaaaaagacaaaccggaaacaccctttatatccttgatgaaccaacaacaggattgcatttcgaagacgtaaaaatccttatggatgctattaatcaattggtagaacttggaaactcattcatcatcattgaacataatatggatgtgatcaaattagccgaccatattattgatgttggacccgaaggaggaaagcatggtggacagatcgttgcacagggaactcctgaagaaattgtgaaatctaagaaaagcttgacaggaaagtttttgaagagagaactggagtaaagatttataaaattattcagtattttgccattccgaaggaatctaaataatttatttcagaatattgagcaacttttaaattaaaaattaggataataatcggctaaactataaggtttagccttttttatgattaaaaatctacctccaatattaaattttcatttattttttaaaaattatttatctgataatcagttaattatattttaatgttaactcagtgttaactgaatgtaaaattaatatgaattatttttaataactttggttaagagatacaaaaataggttagtataatatttaaaaccagttagttatgaaaaatagaattcaaatatgcattgcttcacttttggtttgcggatttgctgctgttttaaacactgctaaagctcagactacagatcatagtaccattcaggaaattcaactgaatagaagtgaaacgtttaatgacatcagaaataaactggaagccaactttgaccttaccaatcctgattataaacagggaaccgtaaactcagtggtgaaatttgatattgctaaaaacgggaaaatcgttaatgttcattctacaggcgactgtaaaaccgtaagcagggaaattgaaacggtactcagcgatcttgattatagagtagaccgaaaaaaactgactgataatatggttgcttatacctatgtaatgccagtgacagtcgaaattcacagcagataatatttattacatattattcataaatgtgtgaataatgaaaccttacaggattaaattgtaataaagaataaacagatatgttttagttttgggctaccataaaattagaactatatgaaaaatttaaagaaactgacaaaatcagatttgaagtcagtgaacggaggagagccggtaaaatattgtacattttgcgaatgggcaaataaagtaatttgcagcgatgttccaatcgttcaatgtccgtaaaaaataaagccgctttataagcggcttttctattatcttgtacttttaacaaattcttttaatcttgccttaagatccccggaattccctattgtatcgaaagtaatattatctatcttccatcttttccctgtattcgtaagatgtatggtatctgtccatgctactttcggtgaagcaaggttgtattcaaatgcaaccggtacttctgctgttatattctttatcctgacggatttaattttataatctgtaaacccttcatataaactggagaaaagagcgccttcaaagattaaaggcttttcatcaggatgatcactgttttttaccttttctatatctgcttttgaagtattaatagcctcttccagaacttttttcagatcttcggaaaacaaatcttccggaatgggttgattgtaaattgcttcattagattttccgtaagtagtataaagctcatttatttttgcattgatggctgcatcagaagataaagaggagtgtgcttcattctttttacacgatgcaaataatagaaagattcccgaaagaagaattaattttttcatggaagtattttgtaaggtcaatttacagtccagatgtcaaaatttataccaacccgtcaataaattattttttgcaaatcacaaaaatcaatacatttgagtagataaaaaaattgtggatcctattcttaacgttgctgtccgttccctctgcgtttaccttttcatggtaattgctatccgtttatttggtaaaaatcagctttcccagctcaatgcaggtgatgtagtacttttactgctgatttcaaatgccgttcagaatgcgatggtagggactgatacttctttgcagggtggcattgttgcggcattggttttgttcgttgctaattttattctaaaaaggataatgttttccagccgttcctttcagaccttgatggaagatgaacctgtggtccttatcagggatggagttacagaccaggctgctctgaaccgcgttaaaataacagaaagcgaacttgaagaggcaataagggagcatggcattgaaaatatagatgatgtaaagctgtctgtactggaagtagacggcaatatcagtgttgtttctcaggacgaaaaaagcaaacagacccactattcaagaattaaaagaaaaattaaaagaaaatatcactaaaacgatgaattacgaattaagagaaatgcttcccactgatgaagccagggtcctggaaattttccgccagggaatagatggtggaatttccacttttgagacagaagttccaactgctgaagcctggagcatgggatattttaacgactgccgctgggtgttggaaaatgaaaataatgaagttgtgggatggtgcgccttaaaaccggtcagcaagagagagtgttacaagggtgttgcagaagttagcatttattttgataacgaataccagggaaaaggattgggttccgtgttgcttaaaaagttgattttagacagtgaagatcacgggttctggacattacaaaccaatatcttctccgaaaatgaaacttctattaaatttcatcagaaaaacggtttcagaatggtaggtatccgaaaaaaaatcggaaagctcaatggagagtggaaagatgttattctgatggaaaaaagaagtgaaatcatttagaattataaattataattgatgaatgatgattgatgattgatgattgatgattgatgattgatgattgatgattgatgattgatgattttgtcgataagcaaaactaatctccataacaaattcattatggacttgcgaagcaaaattgaccattgatcaaaaggctgtatattccaaccttcaactctgaattttaaatttttggcattaccattgttatattaactcaaatttgaaaaagtggaataatgaaaagtatcattaaaattacaggagctgttattatattatcgatgatgacatcgtgtgtcgcttatgataatggatatggatatcagaccaagagacttccgccgggccaggctaaaaaaatctacggtggaagcgcaaaagattatgctccgggacaagtgaaaaaaagatatggtcactaatcagcaataaaattaacagttgatttttatctgcatcatgttgatttaaatactttttggcattatcattgatatatttcgctatcgaaattgaaaaagtgaaaataatgaaaagtatgtttaaaatcgcaggagcagctgtggtagcattgttgttgtcctcttgtgtggtacatgagcatcatggaagaagaatgccgccaggtcatgcaaaaaggtattatggcggaagtgcgaggtactacgcaccaggccaggtaaagaaagtgtatatttatgacgatcgcggacatggacatcacaaaggtcacggtcatggacatcacagataaaaagaaagcactgaattttttcagtgcttttttatgattattataatcttgtttttttcggattaagaaaagtgttaaaaaccatcacttcctgcccgaactttttctcaatcctttcggaaatattcaaaagttcacttttaataaaatcttcacgaagatcgttattatcaaaaattagcaggagattataattttttccttcctcaataaagtcgctgtgcacttcagaaagaatatatttgcttacatccatcaggttttcagtcattaaaaccaatgtttcatcaatataattttcccattcttctagcctgtcttttgtgcagtggaaagttatacttaatacgctcatatttttatgaatttttaagattttttggataaattctacagcaaaaatcggcatttttttcgtaaattagcccgttaataaaaattggaaataaataattttcggacttacagctaagggtctgaatatcattacaataaaatttgtttatgcaaaaagaaggagaaagactgattcctatcaacattgttgatgaaatgaagtcgtcttatatcgattattcgatgtcggttatcgtttccagagcgctaccggatgtaagagacggcttgaaacccgttcacagaagagtactttacggtatgtatggactaggggtgttttctaatagaaaatatttaaaatctgcgagaattgttggggatgttttgggtaaataccacccgcatggagattcctctgtatacgatgctatggtaagaatggctcaggactggagcttacgttatcctcaggtagacgggcagggtaacttcggttctatggatggtgaccctcctgcagcaatgcgttatactgaggcaagactgaaaaaaatctctgatgaggttctttcagacctggacaaagaaacggttgattttcagaataactttgacgacagcttacaggagccgacagtgatgccgacaaaaattccgaaccttttagtaaacggtacttcaggtattgcagtagggatggcaaccaacatggcgccgcacaacttatcagaatctgttgatgcaatctgcgcttatatcgataataaagaaattacgatcgatgaattaatgcagcacatcattgctccggattttcctacaggaggtatcatttatggttacgatggagtaagggatgctttccatacaggaagaggtagagtggttttaagagctaaagttaactttgacgaaatcggaaacagaaacgctattatcgttactgaaatcccttatcaggtgaacaaagctgaaatgattgccagaacagcagagcttgttaaggatgaaaaaattcctggtattcacgaaatcagagacgaatcggacagaaaaggacttcgtattgtttacgaactgaaaaacgatgcaattccgaatgttgtccttaacttattatataaatatacggcacttcaaacttctttcagtgtaaataatattgcattggtacacggaagaccggagcagctgaaccttaaagatatcattcatcactttgtagagcacagacatgaggtgatcgtaagaagaactcagtttgagcttaaaaaagcaaaagaaagagcacatatccttgaaggattcatgaaagtgatcggaactcaggatgctttagacagagcgatttctattatccgtcacagtgcgaatcctcaggctgcaaaagaaggattgattgaagcttttgaactttctgatattcaggcacaggcaatccttgatcttagattagcccgtcttacaggaatggagcttgataagatccgtgatgaatatgatgcgatcatgaaagaaatcgcgaatttggaagacatcttagcgaacgagccaagaagattccagatcatcaaagaagaattgcttgagatcaaagaaaaatacggagacgaaagaagaactgaaatagattactcaggaggagaaatgtctatcgaagatattatcccgaacgaatctgtagttcttactatttctcacgcaggatacatcaagagaacttcgctttcagaatataaaatccaaagtagaggaggtgtgggtaataaagcagcaacaacaagggattctgacttccttgaatatatcgtttctgcaaccaaccaccagtatatgctgttctttactgaaaaaggaagatgttactggttaagagtatttgaaattcctgaaggctccaaaacggcaaaaggaagagcagtacaaaaccttatcaatattgaaccagatgataagatcaaagcatacatcagaaccaacaaccttaaggattctgaatacgtaaatcaaatgagcgttgtgatggtaaccaaaaatggaaccatcaagaaaacatcattagaagcttattcaagaccaagagtaaacggggtaaatgctattgagatcagagataatgaccagctattgggagcttacctgacaaacggaaattctcagatcatgatcgctaccaaaaatggtaaatgtatccgtttccctgaagaaaaagtaagagaagtaggtagaggatctatcggggtaagaggaatcttgcttgaagatggtgatgaagctattggtatgattgttgtgaacgatgtagagaacgaaacagtacttgtggtatctgaaaaaggatacggtaagagaactgcggtagaagactacagaattaccaacagaggaggaaaaggagttattaccctgaacattactgaaaaaacaggtaatctgattgctattcaaaacgtaacagacgaagatggattgatgattatcaacaaatccggtgttgccatcagaatgggaatggatgagatgagagtaatgggtagaaatactcagggagtaaaactgatcaaccttaagaaaaatgacgaaattgcagccattgcaaaagtagaaatggataaagatgtagaggaagattctgaagaacttgaagaaacagaagaaggagttgtaggatcgctatttgataaccaggaagacaatacagtacctcaggctgaaaatgaaaactcagcagaggaaaatgagaattctgattctgaagaataaattgtacaattaatataaaatagttattatgaagaaactaattttaggaatggctatcgtagcgtctgcttttgcttttgggcagaaaaaagatgccaacgctctgaacgctcagcttcaggaaactaataaggccgctatggatgcatacaatgcaaaaaattatgcagccgcagcacctaagtttattgaagtttatgacttattgaaagctaacggacaggacaataaaatatatatgtattatgcgggattgagccacgcgttagccaataacagtgaacagtctatcaaaatatatacagatcttgttaattccggatttacaggagtagaaactacttacactgcaaaagaaaagaaaacaggacaggttgtaaaccttgataaagcgacgtgggagctgatgaagaaaaattcagactatactgatttcaaaacagaacagacaaaaagtatcgaacctgatttatatgaaacccttgcttcattacttcttaatgcaaaaaaaccggaagctcttgctgttatcgaaaaaggattggcaaaattccctaataatgctaaacttaaagaagctcagactacagcataccttcagtcaggaaatacagacaaattcgtttcaggattgaaagagcagttagctaaaaaccctaacgatgctacgaactggtataaccttggagtaatgcaggctaaaaacccggctactgttaatgacgctttagaagctttcaaaaaagcagttgagcttaaacctgacttctctgacgcatatcagaacttggtttatactacgatcggtgacgatgctaaagtagtaggtgaaatcaatgcattgagaaaagacaagccggatgaagcttctaaactgatcgacgcaagaagagaaagatttgcaaaagctttaccgtacgctgaaggatggtataaagctaatccaaaaagtcttgatgcggtttctgcattaaaagaaatttatgtagtaactaaaaacatggataaagttaaagaaatgaaagctaaagaagctgaacttacagctgctggagcaaaataatcattttgataacaacagatataaaaaccggaacagaaatgttccggttttttattttaaacagaaagtgctgactgaggttcttatccggattttatatttcatgtaggagcttttagatctgttataattttgaattaaaatctataaacctaacaggtttcaaaaacctgttaggtttaatttgttaccagcccttctatacagtttctgctgaaaattcttcataccggattcacacattcaaaatttctgttttttgtagtgatgaacctcaaatttcaccttcagaaattctctgtaattccgtatctttgagaaaaatttttataagatgatcgagtggaaaaccgccaaggaatacgaagatattacctataaaaaatgtaacggagtagcaagaattgctttcaacagacctgaggtgcgtaatgctttcagacctaaaacaacttcggaattatacgatgctttttatgatgcctatgaagatccttcaataggagttgtattgctttcaggagaaggaccaagtcctaaagacggaggatgggcattttgcagcggaggagatcagaaagccagaggacaccagggatatgtaggagaagacggaagacaccgtttgaatatccttgaagttcagcgtctgatccgttttatgccaaaggttgttattgcagtggttccgggatgggcagttggtggaggacactcgcttcatgttgtatgtgatctgactttggcaagtgaagaacatgctattttcaaacaaacagatgctgatgttacaagttttgatggtgggtatggctctgcttatcttgctaaaatggtaggtcagaaaaaagcccgtgaaattttctttttaggaagaaactattccgctcaggaagctttcgaaatgggaatggtaaacaaagtagttcctcatgcagaattagaagatacagcttacgaatgggctcaggaaatattggcaaaatctccgacttctatcagaatgctgaaatttgccatgaaccttacagatgacggtatggtagggcagcaggtgtttgccggagaagctacccgtctggcctatatgacagaagaagctaaagaaggaagaaacgcatttcttgaaaagagaaagcctaacttcggagaagatcaatggatatcataacattagtgatgagtaataagtaatgagcaaaatttttcattacttattacccattgctcattacttataaatttatgacgcattggataaaagccgcaaggctaaggactttaccgctttctttaagcgggattattatgggagctttcattgcaaaatggagactttacggagaaggcggaacctgggactggaagatttttgcccttgcccttttggtaacgcttttataccagattttatcaaattatgccaatgattatggtgacggagtaaaaggaaccgatgctaagagaatcaatgaagctgaagcaagagcagtagcctcagggaaaattacggcaaagcagatgaaaaatgcagtaattcttttcgcagcattatcatttattgcaaccattgctttgctgtatgtagctttcattccggattatatgaatgaattctatatcttcataggattgggagtagcaagtattctggcagccattgggtatacagtaggtaaaaaaccttacggatatatgggattgggagatatctttgtgtttatcttctttggattggtttctgtgtgcggaagttattttctctttacaaaaactttcagctgggacatgctattgcctggaacagctgttggaatgatgagtatggcggttcttaacctgaataatatgagagatattgaaagcgacagattatcaggaaaaaacagcttcgctttgaaaataggattcaaaaatgccatgatttatgaaatggtactgttacagcttccattgttgcttattcttacatttttaggaataaatggattcatgaaggaacagaactactatgttttcattgtaatgatcctgttattcccattatcaaaactgagaaaaaagattttgtcggtaaaagagccgaaagaattagatcaatatttaaagcaggtagggatcatgacttttgtaatggcaatccttacagcagccggacttaatttatttcactaaatcccaaaatagtatattatgagttctaatgcatatgttgaagcccaaatgctcatccgaaagccggttgaagatgtttttgaagcatttatcaatccggaagtgaccactaatttctggtttacaaaatctaccggaagattagaagaaggcaaaacggtaatctgggaatgggaaatgtacggcgtaaaaaacgctgtcaacgttcatcagattattcctaaccagctgatcagaacagaatggggagaaccttcgacaaatgtagattatgaattcagaactatggaaaaaggtactcttgttatcattaaaagttatggattcagccagacgggtgaagacctgctgaaagtgattaatgacaatacaggaggttttacaacagtattagacggttgtaaagcttatctggagcatagaataaaacttaatctgattgaggataagttcccatcgaaataataaaattaaacaaacacggatggcacgaatgctttcacaaaacgtcaataatctcattgttctatttgtgaaattatttgagtcatttgtgtttaataatatttaataataattgaaactaaatttaaaatgaaaatacaattcttagggcaaaattgtttcctgttcacatataaggacaaaacaattctgagcgaccctttctacaactacaaaaaagcagaatcaggttttgatattgctgctcaaaaaatcgactacattctgctgactcatgcacacggcgatcatattgctgatgtagcagaagtgttgcagcattatccggaagctaccatcattggagttcctgaagtatgcggttacttccaacaggcaaaaaataaagatgatgtgaacttaggaggatcggcaaaaatcgacgatcttaaaatttccatggttcctgctcaccatacaagttcttttccggatggaagctatggaggcgttcctgtagggtatatcttcagattgcctgaaggtaagaatatctatttggctggtgatacaggagtaatggcggatatggagctgttcccgagattatacggaaacatcgatctttctatccttcccatcggaagccactacacaatgtgcccgagaaaagcttcttttgcagcagcagagctgttaaaaacaccaaaagtaatcggatgtcactttgatactttccctgctattgaaatcaatcatgaaagtgcattaaagcattttgcagataaaaatgtagaactggttttaccaaaattaggagagacgttcgaattttaatcaataacggaaccggaggtaatctgaaaattagaaaatgaaaatgatgcgtaaggtattaaaaacaaaaaaagataattatcaaattacctctcttcttactttaaaccaaaaaaaaatggcaagctacctaaatcacaccgctacgaccgattacctttgctgcgttcccaccctggaggattctcaggagctggttgtttaggacttgccgttgcaaaggtaggaatattttataaacttcaaaactttattagagaaaattagttgaaaaaatgcagtggtaaagctaattgcctgacatttagagggaaaatttttcaacttttttctaaaaatttaaatatgacgaaaagtccatcaacactaggaattatactttttatcgctacaatgattgttttctttgtagtatatacttttttctcaggaatcaattattttgatatctctttgaaagccaacgcttttcttttacctgttttatatgcaggagcggctttctggtctgtaaaatcttactggaacaagcatagagtagtaaaattcaaagaagctttcaaaagagcattcgtaccgatgttcgttggaggaattctttccatcttcagcatttatgcttttttaaactttgtagatcctgctgccaaaagccttctgaactatcaatatgttcaaagacaaaaatcagaactggatacagaatatacctctgcaagaaaaattctgaagcaccagaaggatattgatgagctggatcagaaatacaaggaaagattacaaagcttcaatcctgaagcagttaaaggaaaagatatgcttactgcgagtcatttttcaggatattttgcagcaattcttatattttacgtagttttgtcggtgtttttcggagcgtttttcagaacaagaacaatacatcagcccgaagaaacaaatcaagcctaatttttattaaaattaaatgaatttatctatagttattccgttactgaacgaagaagattctctggaagagcttttttcaagaattgataaagtatgcacaaccagcaatttatcctatgagatctggtttgtagacgatggaagtacggatttgtcgtggagtattattgagaatatgaaagtacagtatcctcagatccacgcaattaaattttccagaaattatggaaaatcccaggcgcttcatgctgcctttgaaagaacaaacggtgaggtagtgattaccatggatgccgatttacaggatttccctgaagaaattccggaactgtataatatggtgatcaatgataattatgatatcgtttccggttggaaaaagaagcgttttgacaatgtaatgacaaaaaatattccttcaaaactattcaatgctgcagcaagaaaagtatcaggagtttatcttcacgatttcaattgcggtctgaaagcctataaaagacaggttgtaaaatctgttgatgtatatggggacatgcaccgttatattccggtattggctgccaatgcgggtttcagaagaattactgaaaaagaagtgaagcatcaggcaagaccttacggaacttcgaaattcggaacagaaagatttatcagaggatttctggatttgataaccctttggtttgtaagtcgtttcgggggaaggccaatgcatttcttcggagcagtaggaactttaatgtttattgtcggtttcctttcagccctttggctagggatttctaaactgattgacgttgccagaggaatttatggacatttaatcaccaataatccatggttctatattgccttaacaatgatgatcatgggaacacttctctttatcgcaggattcttaggagaaatgattatcagaaccaaccgtgagcataagaattataatattgatgaagtgatataatggaagaaaaactgccgagaatttattctaaaaaagccattttaggattttctatttttctttcctctcttttcggaggagttttattataccaaaatttaatagaggttaataaaaagaaagaagcatacacggtgttggccatttctgttatattaacgattatcacaggaattattgtcaatatcccagaagaacctaaaagttcacttgcttatatttgcggctttggagggggaagtttgctctcctactattttatgccgaaatattttccggatgaagagaaatatccgaaaaaagcgatatggaaacccttgattgttggggttgcgattgttgcaatacttttgactttaatcatttatggtacttctgttgaaaatagctaaccatagaaaagttataatagatcatcaattcttatagatttaagaatataatataatgaagagcactctgtcaacagggtgctttttttgtaattttataaaaaaatttaacttaaatgtttcaacccaaatcaattctttttcattttcttttactcctgacaatttcatgttcatccaacaagctctctggttcctgggaatttattgacatttacgacggagagatcaatcgggtagatacattgaaaaacaaaacaaacaaatcaaggtacggaactggaatcctcaccttttatcaggatgaaacattcacttcaatgggaaacgatggaacttatcagatagaaaacaacttgttgaaaatgaaatataatgatgatgaaaagacaattccaatgaaaatttcctacataagcaaagaacatctgctcttattttcaatggctggaagtccgaaaacctggttttataaaaaagtaaagaagaatagcaaataagtctcttcctgagaagcagaaaattgaaaattatcaggtattttattgtcaaaagacaaagatttttagaaattttaatcctatttttgttcgaagtaattattgaaggtcctttgtaaggcatgaaaaacctttcggagattttcagtaaaatcgttgcgattgtaatatgaatatttaaaaataaatatgaaaaaagttgtatacacattaatgctggcggcactggtttcctgcggaaaagtttctccaaaaggaaatattgagaagaaagatgtggatgtaccggaattcgtcaatcttgatctggaaggaaagttccgtgtattttatgccagagggcctaaaaattttgtagaaatagaaacctatccgaatgtggccagtaatctggatgtggatgtgaaagacaaaacactttttataaaagaaaaaagagggacaaagggagtcgatttttataatgtaacgatctattcaaaatataaccttgaaaaagtagcggtttcagactctgtggaaatgaatatttcaagcgagattaagaccgacaatttcaggcttgctatgaagaataatgccagctttatgggatctgtaaacaccagaagggcagaagtggaaatgcagaacagaagccgtgctaattttttaggattaacaaaagaagcggttataaaaatctcagatacagcgagtttaattgctccttactggaagattaccaatctgaatatcgattctaaaaacggaaattatgcagaagtaaatgtaaaagattctttaaaaggacatattcagaacacggcaaaatttgtctattataacgatccgatcagggcgtttaaaattgataaaacaacgaaagtcgagaacaaaaaactggattaaaaacagtattattaaaaccaggaactttacaactataaagaacaacatataaatatgaatacactagaaaaagcgaaactttggttaagtgataccttcgataaagaaacgagagacgctgtacaattactgattgacagcaattcccctgatctggaagattctttctacagagaactggaattcggaacaggaggaatgcgcgggataatgggagtaggaaccaaccgcttgaataaatatacgttaggtcaggctacacagggattggcgaactatatgctgcagcagtttaagggagaggaaattaaagtggccatcgcttatgatgttcgtaataactcaaaagaattcgggaagctggtggcagatgttttaacagccaacggaattaaagtattgcttttcaaagaccacagaccgacaccggaattgtcttttaccgttcgtgataaaaaatgtaacggaggaattgtattgacagcctctcataatccgccggaatataacggttacaaagtatactggaacgacggagcacagattgttccacctaatgatgaagccattatcaaggaagtatattctgtaaaatttgaagaaattaaatttgacggaaatgatgatctgatcgaatggatcggagaggagcaggacgatgtatatatcgatgcatgcattgaaaactctacctatcagaatgttggaaaagaaaatttaaatattgttttcacatctatccacggaacaacctacacaaccgttcctaaagctcttgcaaaagcaggatttaaaaaagtggatcttgttaaagaacagatgatcccaagcggaaatttcccgacagtagattctccaaacccggaagaacctgcagcgcttgaaatggccctggatctggcaagaatcaccaatgctgacattgtgatcggaacagacccggatggggacagattaggaattgcagtaagaaatcttgatggcgaaatgcagcttttgaacggtaaccaaaccaatacaatccttacttattatatcctgaatgaatggagaaagcaggaaagaattacaggaaaagaatttataggttctacgattgtaacctcggatattttctttgacatagcacaaaaattcggagttgaatgtaaagtagggcttaccggattcaaatggatcgggaaaatgatccgtgaagcagaaggaaagcagaaatttgtgtgtggcggggaagaaagtttcggatttatgaccggagattttgttcgtgacaaagattcttgcggaagtattcttttagcatgtgaaattgcagcatggtgtaaagccaatggaagaacaatgtaccagtacatgatcgagatttacgaagatcttggaatgtattacgaaggattgatcaatattgtaagaaaaggaaaagaaggtgctgaagagattcagaatatgatgaaaaacttccgtgaaaatcctccaaaagaattggcaggatcatcggtagaactagttaaggatttcaaggaacagacaagtcttaccatttctaccaacgagaaaaaagtaatgaatgatattcctgcatccaatgtattgatctattatacacaggatggaacaaaagtatgcgtaagaccttcaggaacggaaccaaaaatcaagttctatgtttctgtaaaggattctatcacttcagaatcagactttagagataaattaaaatcattggaagctaaaatcggagctgttaaaacagatttgaaactggattaatttcccgaaacagcagatgattaaaaaaataatagcagtttgcttactctctgcagccgtagtttcctgtaaaaaggaagctgcagctgcaggaataaagcagaagaacgattcaattgcccggactgagcctaaagaagatcagtataaaccgatagatacggcctgttcacctgccggtaaaacggaggattatatcaaatctcttcaatggtaccggacaaaaatcgaaaaagaaatgacaggaagcaatccggaacagaatgacagagtatatgaagattatttaaaaataagagataagtatacagaatgtctgatgaatttgcatgctgatattttggataaatatgtgaattattatgatcctgataaagatcggtacaactttccggaccatattaaaaagattgcttcagaactgaaaaaagcaggtcttgaattcagggaagtaggagaagggatgactgaaatatggaccgttccgggatattactcttctttgtttaagaataaggtaacgccggattatgaagcctatattttgcagaatgacaaagaaagtgaatccaattatgccgcggatgcaggactgatgatttcctgggaacagctgggagacaggctgatattctgggagaattttatgaataaatatccggaaagtaagcttataaaggatgtaaaaacaggttatcaaatgtatttgtctgactatcttttgggaatggaaaatacgcctacctttgaaagagatctggacaaagaaaccggaaaactgtacgatgaaaacagagcagagttcaacaggattatcaaaaaatatccgaattccaatacagcaaaaaaagcaaaagaggcaatagccctttttgatgcgcaaacaccggtagatcaaatatatgagaagatcaacagagaacgataatataaattttaaataaaaaaaagtgaaagtttcaaaattagcagcgaacctgatcggttctgaaattgtaaaaattggtaacgaagtaaatgacttaaaagcaaagggagcggaaattgccaatcttactattggtgatctgaattctaatatctatcctattccggcattgctgaaggaagagattcagaaagcttatcagaataatctgacgaactatcctcctgcaaacggacttttatctttaagaaaagaagtttccaaagaccttaaacaaagatggaacctggattattctcctgaggatattttaattactgcaggatctagacctttgatctatgctgtatacaaaaccatcgtagatgaaggagataaagtagtatatcctacaccgtcatggaacaacaatcactatgcttaccttacttcggccaatgctgtagaagtaaaaacaagacctgaaaccaatttccttccgactgctgatgacctgagacctcacctggaaggagctgttttattagcactttgttcaccattgaaccctaccggaacaatgtttacaaaagaacagctttcagaaatctgcgaactggtaatcgctgaaaacaacaaaagaggagccgatgaaaaaccgttgtacctaatgtatgaccagatctattcttgccttacttttggagcagcgcatgtagatcctgtttctcttttccctgaaatgaaagactacaccatctacattgacggtatttcaaaatgccttgcagcaaccggagttcgtgtaggatggggatttggtccttctcatattcttgataaaatgaaagcgcttcttacgcacgttggagcatgggcaccaaaacctgagcaggaagcaaccgccaaattttatgaaaatccggagaacgtaaatactttcgttaatgattttaaagctaagcttgaagaaagtttaaaagttcttcataacggagttcaggatttgaaagcaaaaggtctttctgtagacagtatcgagcctatgggagcactttatcttaccattaagcttgattatatcggaaaaacaaaacctgatggaactgttatcggaaactcttcagaccttgtattctacttaattaatgaagcaggtgttgctttagtgccattctctgccttcggggaagaaaaatcagaaccttggttccgtgcttctgtaggaggattggcggtagatgagatcaaagtaatgcttccgaaactggaaaatgctttgaacaatttaaagtaaccttcagataaataaatgcatcgactctgtccggcatgacatcgttaaaacaagaatcagtattagcattgtcattccagatagagtcgattcgttttcttagagatatttaaactgatagtataaaaattaaataaatattaaaagttaaataagtgctttgtacaacactcaactaggagctatctttgggattttacacacctaaatataaaagttgaaaattacaacgatgaaaaaactgagatttctactcttgccagtttcaatactggtatgctcgcaagaggttgatacattgaagataaaagaacttccaaaggaatctgagttgccaaaagtacaaacctatacgttaaaggacggatctgtcagaacctatccaaaaccgaaactactggattttgtaaccaaattaccccggaattttatcaataccaataaagatttcgtagccaaagatcatggttattatcttggaggagcagtggctgcaacacttattctcttaccttttgatcaaaagcttattgacaattccagagagctgggagaaagatggggaatggataaagataacaactatcacaaaattggaggtgtctttaaaattcctaaagatatcgggtctaccttatatctgataggaaacggttctacattggtgctgatgggtattggtttcggaacctacggtcttatcaaaaatgattacagagcacaggctacagccagcggtttgatggaaagtttaattctttccggagtttttacccaaacccttaaaagaattactgggagagaaagcccatttattgctgaaataaacgggaataaaggaggagcatggaatccgttcccaagcttttcggcattcagcaaaaacacttcgaattatgatgcaatgccttccggacatttaacaacctttatggctggtattacggtgattgcagacaattatcctgatgtaaagtggattaagccggtaggatataccttagcaggagcattatgttttcaaatgatgcagagtaaagtacactgggcttcagattatcctttagccttattaatgggatattttatcgggaaaacaatctcaaaaagcagatatacttcatcagaaggaacgataggaaaaacaaaatataatctcaactttgtggcatcccgccaatgggaatacaatttggtaggggtaaaactctctttttaagctgctgaaatctttgttttgtatagtaaataagatacttttcactacatttgatctcaatataaaggaaacattacagcatgatatatgctgaaatggcaacctgttgaattaaagagaattacttaatacttttactgaatgaaaataatcgctgttattcctgcccgctacgaagcaagccgttttccaggaaaactgatgcagattttaggagaaaaaaccgttattaccacaacgtatcagaatgtagtggaaaccggactgtttgatgaagtatttgtcgctacagactctgaaattatttttgacgaaattcaaaaaaacggtggaaaggccgtaatgacaggccagcatgagaccggaagcgaccgtattgccgaagctgtacaacatatagactgtgatattgtgatcaatgttcagggagacgagcctttcctaaaattagagcctttacaacagctgatagaagttttcagacatgatgatcaacaggaaatctccttagcttctttaaaaatacagctgcatgaaaaagaagaaatagaaaacccgaataacgtaaaagtgattacagataataatggttttgctttgtatttcagccgttccgtaattccttttcacagggaagtttcttatgatgtaagctattttaaacatattggagtttatgctttcagaaaggaagccttgctgcagttttcaaaactggctatgaaacctttggaaatatccgaaaaaatagaatgtatccgctatcttgaatacggaatgaaaatcaaaatgattgaaaccaatttcataggagtgggcatagataccccggaagatctggaaaaagccagaaaactgatttaaaatattgaaggcaaaaaagctaattatcaaatgctcttttgcctttttgtaattttacagaaatccccctatatttgaatttataaataaaattaatgaagaagttattattagtatttggactgatattttcgcatgtcgcatttgcacagaccgcaaaggaaattattgacaaaaacattgaattatccggagggttagccaattggaaattattgaattcggtattgcttcagggaaaagtaattttaggaatcaaagatgaatatccgataaaaatctatcagcagcgtccgaatcttactaaaacattgattactaccggtggaaaagaaaccgcaattgaaggctatgatggaactaaaggctatgcaatgaattatgcagccaataagcttcaggaatatccagaatatgttccggaaagttttgacaatgacttcattgattgggaaaacaaaggctttgaggcaaaatatcttggaaaagaaaaagtaggagagatctactgccataaagttgaactgaccaagaatgtcaataagaacatgtactattttgatacaaagacctatatgctgatcaaagaagtgaaaaaagatgaaacactggtgtattctgattttaaaaaagtgggaaatcttatcatgccattcagaatagaatcatcaagtgccaagaaagacggagattacgtaatgctgctcaacagaattgatatcaacaaagtgtttcctgcaaatatttttaagttttaatcaactgcggttcgctgcacaaaattataaaaaatgaaaaaaatttttttactgctgctttcattcatcgcatttctgcaaagctgcaccaaccaaaaaagtgaagtttctaaagctaaaaccaacgaacttatgggaaaaacaatatacgacttcaaagtagaaagtcttgatggtaaggaaatcaattttgctgatttcaaaggaaagaaaatcctgattgtcaataccgcttcagagtgtggatttaccccgcagtatgcagatcttgaaaaagtatacgaacagtataaagataagctggtagtagtaggtttccctgccaataatttcggaggacaggagcctggaacaaatactgaaatcggggctttctgccagaaaaactatggtgtaacatttcctatggctgcaaaagtgtctgtaaaaggtgatgatacagctcctatctttaagtatttaacagaaaaagaattaaacggagtaaaaaatacaagcatcctttggaactttaccaaattcctggtagatgaaaacggaaaactgattgattcatttgtaagcactacaaagcctaccgatgaggccattacaaaatatctgaaataagaattattatatggattttttggatcggtttgaagcctgtattatgagcggagcaattggagatgcatggggaagcagctatgaaaatgaagtagaaaccgatgattcacatatttattatttaggaaaaaagaataaaaagcgaagagtctggagtattacggatgatacacaaatgactttggcaacctgcgaggttctgtctgatagttttactcccgaaaatcttatcaatagatttatagaatattacagaagccgcaaattaacaggaattggcgcttctacacttaaggcaattttagatactgaagcgggttttcattggagtcaggctggacgaattggagagtttgccgcaggaaacggaggagcgatgagaattgctccttttgcttttttctcagatattacaagagagaatgtttacgaagcatgtaaattaacacatagaaatgatgaagcgttttctggagctttagctgtttttctttctataaaagcaatcctcaattctgattggaacggaaaaaataatctttttgatattattattccagaaattcctgatacaaatgtaagagacaggttaatcgaaatcaattcaattggaaataactcttcaatttcagaaatatcaaaattaggtaataatggctatgttgttaattcagttccttttgcaatttattgctcaaccaaaattattgatttaggtctggaagaaatgttgaaacaaattatcagtactggaggagatacagataccaacgcttcaattgccgggcaaattgccggaacattaatcggaactgaaaatattccttatgaattaattttaaagcttagaaaattacccgattacaaatggatcaagcgtgttattgatgcgacaaaacagagaatcagttaaaatattattgattgcttttttccgcaaaacagaaaatattcccgagtttgatactggaatagccattactttttattttcgaagaattaatcatagcctttgccaggatatccgtcggcagaggtttttgactttctaataaacccaatttattggcaaatttgataatacggcttcccaaaacttctccggttctttcagaatcttttcgctcaagcattcctggtttgaaaatagtaatcttattaaaatgtaactgttttacagcttcttcaagttcccctttcattttggaatagaaaattttagactgcgggttagctccgtaagctgataccagaatataatcttccacattgttctctttcgccgcttttgcaaattcatattgataatcaaaatctacttttttctgggcttccttgcttccggcatcctttaaagtcgttcccagacacgaaaaggcaacgtctccttttaccatatctttccattcttcaggcttttcaaaattcacaacatgaaccttaagcttatcattatgaatatcaacaggttttctgacgaaaatatctacttcatcaaattctttatcattgagtaactgattcaccagatcttttcctgtggcgcctgtagcacctattaccagagctttcataataattgtgattttgtaagattatttctttcttaaatttactaaatttgaattaaagagtaaagaattaatttaatcattactcattgcttatcactcattactcaattaatatggatgccaacgaaattttagattactgtcttgccaaaaaaggagttacggaaagttttccgtttgataacgaaacacttgtaatgaaggtagataccaaaatgtttttattaatgggccttgaaaaacaaccgctggcgatcaatgtaaaaacagatcctgaatggagtgcagagcttcgtgagcagtatccacagattacaggggcctaccacatgaacaaaacccactggaattctgtaacagtggacggattgaaaagagacctgatctttaaacttattgaccaatcctatgatctggtttttaaatccctgactaagaaagctcagaatgaagtcaattctttgtagaaaataagaaaagacagggtatggtatttgttatctttcaacagtgaaatatatattaaatagtaataaaaataaataacaaatgagaaattaccttttattattcgtaacggccggaacgttgatgctgacaagctgtaccaagccggtaaataaaaatactgatacaaaaacagaatctgctctatcagctactgaaaaagctcccggaactcttaaaatagaattttcagggacagatcaatttaccataaaaagtgccctgcttaaagtaagcttatatggagtagacgaaaaactggctgatgcgcctgccacattaattacagaacaggagtatgaacagaagtcggtacctttcaccatcaatctgcctataccggaagatgccgaaagcaagattaatccaaagcctgcaggcccaaaatactatgtggcgataagctgggattctgacggcaatgggaaagccggtgaaaaaggtgatattgttattgactatgacaagcagtttccgaatgtaaaactggataatgaaactcagaaaatctacttaaaacaattgaaataaatcaaaaggctattcggtgagaatagccttaactttttaaaaattgaattcttctgttaatttcttatcgtcatccagcctttcaatcaacttgtcaagaccttcaaatttgatttcatcatgaagaaaatccctgaaacttaccgtaatcttttcgttataaatatcctcatcaaaatcaaggatataaacctccacagtcagtttttctccgtttaccgtcgggttggttccaatgctcagcattcctttatattggttgccctttacaaatacctctacaatataagctccttttttaggtaaaagcttgatagattctgtatcaatattagccgttggatatccgattgttcttccgattttcttgccatgcaccacagttccggaaacagagtaggaatatcccagcatttcattggcttcctgaatattgcctgctaaaagtgcattacgcacttttgtggaactgatgttgttttcatgaatattgatagcctccatttgttcaacttcaaaaccaagttcttttgacaatttttgaaggagctcaaaatttccgcttttgttttttccgaaagaatgatcgtagcctataataagatactttacattaagcttatcaactaaaatctgacgtacaaattcttctccggtcagatttctgaattcttcatcaaattctttcagaaacagattatcaatgccatatttctccacaagctgtttcttttcctccagggtattcagaagctttaaatcttcattcggattaaaaacaaaccttgggtgcggccagaaagtgaggatagcagtttccagattattttctgtacctatttgagtcagttcatcgataatacttttgtgtccgagatgtaccccgtcaaacattcctaaagataatgctaaaggcttctgtgaggaataatctgtaaaattcttgaaaactttcaaaacggaaaaattttgattgcaaatatagatataatgtaacaatctatcaatataacaatgtatcaatatttccggaagggaaaatatgagtgtgggagaggtaaattgctgtattagtaaatttgtaaaagcatgataaaaatcttttttttaccaattgcgggtttatgaagaatcactatatttgcaccaagaaaaaatttagcaatggcaaaccaaattaaaggtaaaatttctcaaattattggtccggtaatcgacgttgtcttcacagatgtggaagctgttccagcaatctatgacgcgttagaaattacaaaagaaaacggtgaaaaagtagttttagaggtagaacaacatattggcgaagatacagtaagatgtattgcaatggacgctactgacggtcttaagagaggacaagatgtaatcggattcggaaatcctattatgatgccaatcggagaggctgtaaacggaagactattcaacgttgttggtgatgctatcgacggacttcaagatatttctaaggatggtggtcttccaattcacagaccagctccaaaatttgatcaattatcaacttcagcagaagttttatttacaggtattaaagtaatcgacctagttgagccttacgcaaaaggaggtaaaattggattgttcggtggtgccggtgtaggtaaaacagtattgatccaggagttgattaacaatattgcaaaaggacacggaggtctttcagtatttgccggagtaggtgaaagaacgagagaaggaaatgaccttttaagagagatgttggaatcaggtatcatcaagtatggtgatgatttcatgcactctatggaaaacggaggttgggatctttctaaagtagatttagaagcgatgaaagattcaaaagcagcattcgttttcggacagatgaacgagccgccaggtgcaagagcaagagtagcactttctggtcttactttagctgagtactacagagacggtggagaaagcggacaaggtagagacgtacttttcttcgtagacaacatcttccgttttacacaggctggttctgaggtatctgcacttcttggtcgtatgccatcagcggtaggttaccaacctacacttgcttctgaaatgggtgcgatgcaggaaagaattacttcaactaaaaatggttcaattacttcagtacaggcggtatacgtacctgcggatgacttaactgacccggctcctgcaactacgtttgctcaccttgatgcaactacagtactagacagaaagattgcttcattaggtatctatcctgcggtagatccattggcttctacttcaagaatccttgctccggaagttattggtcacgatcactacaactgtgctcaaagagtaaaagaaatccttcaaagatataaagcacttcaggatatcatcgcgatccttggtatggaagaactttctgaagaagataaagcggttgtataccgtgcaagaaaagttcagagattcttatctcagcctttccacgtagcagagcagtttacaggtatcccgggatcattggtagacatcaaagataccatcaaaggattcaacatgattatggatggtgaattagatcacttaccggaagcagctttcaacctgaaaggaactattgaagaagctatcgaagctggacaaaaaatgttggctgaaaacgcataaattattaacaatttgagatttgaaatttgagattcgatgagtaatttcaaatttcaaacatcaaatttcaaatttgtttctatgaatataaaaattttaacaccagaatacgtagtttttgaaggtgaagtagactcagtattactgcctggaaagaatggtgaattccacatcatgaaaaaccacgcaggaattgtttcttctttggtaggaggtgatgtaaagctttttgccaattctattgatgaggcttttgctaaaaacttcacgaaagaatctggaaaagactctgtttttgcttatgctatcaaaagcggtgttgtagaatttaatcataataaaggcattatcctttgtgaataattaaatgaaaagctaaatatattttcaagaaagtgtaactttgtgttacactttttttattgatgtaaaagtctgattttatgaagaaaagtataatcatattctttacagttctgagtgttttcctccatgctcagaatatcaaaaccaagaggggaattattaatatagacggcattccggtggctaagctatccaacaaatccagcgaatatacttttatggatctgaaggagaccccgatatacacgataaagtttattgataaaagtatcgttgattccgtgcgtgacagctatatcagtatcaacagggtatacaacagggataaaactatagaagtagactattcatcaccttctgctttttcgggagaagaaaaatctgcagtttttacttcagtgaaagatcttaagatcattgataacaaaggcatcaatgtcaaaaatcttgatgagcttttttccaatgttccgaaaaggaaactggacgctaaaacaaaagatgcttatgcgatcagaaagaaaatagacaagatgaatattgaggtcaataaagtaggagagattctcagcaatggtgttcctgtagggtattttaccaatttacctgtaagctttggatctgaagatacaattatggataaaacgcctatagatattgaaatctatgatgccaaaagcaagcttatcggaaggtatatcacgaccacaaaacagcttaaaacagccggaggcaaatcttttactatttacagggaaatgtcggggagagcttctattctgaaattccctacctataaagccttagcagaacgcatggcgatcatggatcctaattttattaaagttcaggagaaagtctctgtaggtaacgtatcaaaggagactccaaattaaagctctgattaaaaaagaaaaatattttcgtatcaataggaacgggctttagcccgttttttattatggattaaattcatccgttttcagtcaaaacttaaaccaccccgtcaaaaattctttgaattttcgccacccctccggaggaggggaatattttgccgttttatttgtagtagttagaaatttggatttgatttcttagttatggaaaatagaagattctctctcaaaattaagatctgtgcaaatccgcgaaatctgtgggaaattaaattcaagcaggtgttattcgttcagaaaaaaatgacaaaaattctgcaatcacaaaaatccctgagaaaaaacggaaatttttataaacttaaaatcactccgttttccttcaattgctgcatcggttttgagaaccagaacagttcaaaatcttcaaaattttcctcaaaattatttttaagttgctgaactgtaggttttttagaattttcaattgcattttcttccagcacattcatcagccatccagctttttcctgttccagttcaatctttacaatattggtttttaagtggaatgtaagcagcgtatatgtaccggaatatttctttttattttttacgcgattctcagcgattacgtttttagttaaaaagacaacttttgaattcgttttcaattgaaactgcccatcttccaaaagacagtcgtgaatgtaatcctgatgaatagttgttctcggaattttaaaatcaaaccattcctggagcggcaattcaaaattgactccatgcatatagttgaacagagatttctttaatccaaaactaaacttgttatgatcgattccggttttatctttaaaatccacatcattattggcaaacaggatttcctgctttacgggaaccaccccaaaatcttccgggctcattccaacaggcgaatgtgctgtcatagcaaactgatgccagaaaccactttgaagaattcccatctcaaacatctgtctgaccatttccaatgaatcaacagtttcctgaacggtttgagtagggtagccatacatcagataagcatggaccataattccggcttcagtaaaatttctggttacattggcaacctgttccaccgaaactcctttatcaattaatttcagcaatcggtcactggccacttcaagccctccggaaacggctacacatcctgaaagtttcagaagatagcacaaatcacgggtgaaacttttttcaaagcggatattcgtccaccaggtaacgaccaggtttcttcggagaatttccagagctacttctctcattaaagcaggtggtgccgcttcatctacaaaatggaatcctgtttcgccggttgttctgatcaattcttcaatccgatctaccagaattttagcagaaataggttcgtagatcttgatataatctaaagaaatatcgcagaaggtacattttccccagtagcatccatgtgccattgtcagtttgttccatcttccgtcactccataaactgtgcatgggattggcgatttcaataacggaaatatattgatccagttttagatctgtataatcgggagttcctatttcagattgtttaaaatcatgtcttttagaattgtttttatagacaactacattattttcgagaacgaaagtccttttaaattcagcttcttccgcagggatttctaaattctgatgaagcagttccaacggaagttcgccatcatctaaagtaataaaatcgaaaaactcaaaaactctctggtctttaacttctcttaattctgtattgggaaaacctcctcccatcgcaattttaatgtgagggtagtgcgttttgatccattgggcacatttgaaaccggaatacagattccccggaaaaggtattgaaaaacaaaccagtttaggctgtacggcttcgattttttcctgaagaattttcaaagtaaactcatcaataaaggtgggctcaccagataacttagaatataattcatcaaaagaattggcactttttccaagacgttctgcatatctgctgaaaccaaaatcaggatcaatattttctacaatataatcggaaatatcttctaagtagagagttgccaaatgtttggctttatcctgaagtcccatatttccaaaagcaaattccatatcatccagctggttgaaacgggaagcttccggaagaaagttcatgctgcagatctgtcttgccaatgttggtgtttttccctgtaaaaaagggataacctgatctatcgtttttaaatactcttctcttaaagcataaattctctgggaattttcagaggtattctgaagatcaatttctttattgaaaaccttctggattccgtctttagaaaataattccaaaataacatcgatccccagatctacctgatagctggaaatatttttggtatttagaaaccctttaatataagccgtggcaggataaggagtattaagttgggtaaaaggcggagtaataagaagcaggtctttcaacagaaaatttttgcaaagttattccaaagtttttttagaaaaaaatttttccccctgattataaacagtgaggaaaagtctttagagttccggcttattgcaatttctgtctcaaaacaaatcagccggtttaataaataagtgatccggagcactattttcaataaagcttaaaaaagcatcttcatcgaaatatccgtcctgatcaagaatcgcaggattcaacaataccatttcactgggtttttccagactgatattctcaatgaattttccagttttcccggttatttcattatgaaaactgattaaatatctggagtaaatatttccttcagctacagtgtaatgcccgttttctgcaataagtgcggtcataatactgcctccggtataggtttcattatcattaccagacgctccgaacaatactctggcagtaatggttcctgaacagtataaagaaccgttgatgattatattttctgcctctatattaccggttacaataagaactatatagtcttcaacatatagttttccggataaatgaagatcaccttctatgagaacaattttatatccttcgccttctttggtaatcagttcgagagatgtattgttttcactttctgtgaggacaatttcggggacatcactttcatgattggtttgcagagaggcttcttttattttttctgcaatttcatcatccagcatttcaagaaattcagcaaggctttcttcatctaaagtgctttcattgaaaaaattattttcaagagcttcacgggtgatgttgtataagttttctgatttctctttaattctattatataactgatctttagtaagtttctgcaactctttcataggcttttataatcaatgcatttatctgttatagaaggggaacacctatcaatagacctatgcaatatagtcagataaattttgttataccagagggtgtaatgaattgttgaattttttcaatcagataatagatacaaatagttactttttatttaaatgatatggtccttattgataacattccagtttaggcatgattcagatttttacgatccgttattacatttaaagtaacccctaagaggatcagtgtaatgccgatcattaagttattggtgaatttttcatgaaatatcaggacactgatcaatactgcaactacaggttccagcgcccccagaatagcgacaggagtagatccgatatatttaatggcatacaccagacaaagactggatattaccgttgtgagaaatgcaaaaatgaggaagttaatgaaaatctctgcagaaggaataacgaaggatgcatcagccattgcagctttgctcataaagaacatggatgtaaaaaacatagaatagaaggtgagtttaaaccctgaaaccttaatgtttgatttgttgacaatcaccatatacagagcataaaaaagtgaactgagcatcacaattcccaatcctgtaaaattgatttccagcccgtttccttttaagcatagaacaataaccccggcaaaagcaagaagtaaagaaactattgataatcttgccagtttctctttgtagaaaaaaaacataagcaatgcaacaataacagggtaaataaataaaacggtagaagcaattcctggcgtaaggaaatcatatcccaaaaacaaaaattccgaagaaagagcatagcaaactccaagaaccgccagtattaaggcttctcttttattgattttaaaactttctttggaatacacgagatatcctcccaccattaaagctgaaaagaaaaatctgtaaaacagcgtaatatccattgaaaagtgggcctgcttaacgggcaggataaaaatcggaatcaggccatatgaaacagccgacagaattcccagtgcgtaacctctaagtttcatgtgcttttatagttgagtcgtcctaaaataggttgacataaattaaacaatatttaatccggagagatattttatttcttcggattttttatgcactttatctggagtttgcatattaaggcttagatgtggataattagtattataaagacaaacta

SEQ ID NO: 20 - DNA, 658480 bp, Chryseobacterium sp.
tctacttgagaaactattcttaatttaaaggctatactgtagtctttttgtgtgcgcttttctctttttaatacttgatctttcataaataagtcgattagttgtcaacttatttcaggacgagacaagttattaaaaaaagccactgaatcaatcagtggcttttttttattttgatgaattaaatcggtttaaaacttaatccttgttcctgcagtaatttttgttcctgctctttgtagtagccacctactaatttatcatgaattgcttcaaatgctgccagagtttcattaatctcagcatctgtatgagaagcggtaggaataagtcttaaaagaatcattcccttcggaatgaccggatataccaccacagaggtgaagataccgtaattctctcttaaatccttaaccaatagagtagcctctaccggagttccctgcatcattaccggagttacacaagtattggtgtctccaatattgaatcctctttctttaagtccgttctgtagcttgtaaacattctcccaaagtttagctttgatctcaggtcttgatctcaatagttccagtcttttcagacctccgatcaccattggcatggtaagggattttgcgaagatttgtgatctcaggttgaatttcagatatctgatgatttctttatcacccgcaaggaatgctccgaaaccagccattgatttggcaaaagtagagaaatacacatcaatctgatcgttgcaatcctgctcttcacccacaccggcacctgttttaccaagtgttccgaaaccatgagcatcatctaccaataatctgaactggtattttgacttaaggtcgcagatctctttgatttttccctgctggcctctcatcccgaaaaccccttctgtaatcacaagaatacctcctcctgtttcttcagctaccttagttgctctctgaagatttttctcaagacttgccatatcgttgtgcttataagtaaatcttttacctgaatgaagtcttactccatccacgatgcaggcatgagaatccatatcataaacaattacatcatttctgcttaccagggcatcaatagtagaaaccattccctggtaaccgaagttcaataaatatgctgattctttttttacgaagtctgccaattctctttccagctgaaggtgctggtctgtttctccggacattgctcttgctcccatcgggtagaacattccatattcagccgccgcttttgcatccgcttcaattacttcaggatgattacacagccctaaatagtcattggcactccagaaaattacttctctaccctgaaactgcattctagggcctataggtccctctaatcttgggaaaataaaatagccttcaccataatctgcaaattgtccaagtggtcctggattttcttttattctttcaaaaatatccaacattgtatcgtaatttttaagtaataaagccttttttgtctgaatacgcaaaaggctttatttatttgtatcgtgattttattcgttcttatttgataaactccgttttgaaaacttcgtcatagttatgaacacagttgttgacaaatccctgctcagccatccatttatcactgtatactttagtgatgtatcttgagccatggtcaggataaattaaaacaaccaggtcgttttctgtaagttcatgagactgggcatactgcattagtccctgtgttacagctccggtagtgtagccacccatgatcgcttcttttaaagcaatttcgcgggttctgtaggcagacatttcatcatttacccttacaaactcatctaccttgtcaaaaagcagggcagaagggatcaggtttttacccattccctcaatctgataaggatgtacatcttctttgtgaatttctcctgtctcgtgatagctcttcagaatagaaccatctgcatctactccgatgatcttgatatccggatttttttccttcagaaacttcgccgaacctgataatgttccaccagttcctgtacaggcaaaaaggtgagtgatcttaccttgtgtctgttcccagatctcaggacctgttgtctgataatgtgcatcaatattaagctcgttaaaatattgattgatgtaaatagaattaggagtttccttagcgattcttttagctacttcataatatgatctgggatcatcagccggtacattggccggacatatatacaccgtcgctcccaatgctttcaggtaagcaattttttcgggttttgttttatcacttactgcaagaatacatttatatcccttaatgatacataccatcgcaatagaaaacccggtattaccggaagtagtttctacaactacagaatcttcttttaaaaggccttttttctctgcgttctctataatatgaagtgcgattcggtctttggtggaatgtccaggattatatgattctaacttggcataaacggttgctggaatatcttttgtaacagtatttagctttaccataggagtatgtcctatcaggccaaggatattatcgtaaacattactcattatttgttattttcaataaaaatctgactgcaaaaatacaaaaaaataaataattactaaacttttgtttgatttctagggcatagtttgtaaaaaattattttcgtattttcagttttgacacgagtataatcgcaaatactacgccaaaatttttaaattttgttaaaacccgcataaaataagataaaagccttattttcgcataattgatttaatactatgaaaaattggacttttaggcaatggaacaccgtctcaggatgggtgattttcgtcattgcgtttttcacgtacttgtccaccatagaacccaatttcagtttctgggattgtggcgagtacatttcttctgcagtaaaactcgaagtaacgcacgctcccggagctgctttatttcagatagtgggtgccgtggcagccatttttgcattagggaaaggcgaaaattactccatcgtgatcaacgcgatgtctgcattgttcagtgcgctgactattttatttttgttctggacgattacccactttgtgagaagacttttgaacaaagattttgaagaaattacgaaacatcaggaaatctctatcttatttgccggagcagtaggagcactttgctttacattctcagatacattctggttctcagcagtagagggagaggtttattctatggcttctatgtttattgcgcttttggtctggttgatcaccaaatgggagaatgagtataaagcgggagacagtgaaagatggatcattcttattttcttcgttttaggactttctgtgggagtgcatatgatgtgtatgctggcgatccctgcagtatgtctggtatattatgcaagaaattataagtttacctggaaaaactttatctgggcaaaccttatcacattgggaattttgattattgttttcaaaattattttccctctgattatgacgatgttcggaagacttgagattttcttcgtgaatggtcttggacttcctttccactccggaacaattgctgcttttgttttgatggtagtgatttgctatttcttaatcaagtatgcaagaaaagcaaaaagaaacatctatcagacggctgcactatctgtggtgtttatgatgatcggattctcctgctggatggttattccaatcagagcaaacgccaatccgccgatgaaccttaatgatccggatacagcaattggtatgctggattattataacagagagcagtatggtgactggccaacaatctacgggcagaattatactgcattcctggatgctaacggaattgagaaaaatgaggacggaagcttcaagacacaaaaaaccggagaaatctacgaaaaagatgaaaaaaccggaacatacagaaaaaccggagaccgtttcaactatatattcagcaagtctcaggtaagcttaatgccgagaatgtttaacgaagataaggatgtaatggcgaactatatttcgatgtatggtgctcctgattttacattcaactatgctaacgaagatgtggcagacaatccgcaggctaagcagatctttgatgagctgagagcaaaatatgaagataaatcgattaccgcttcagattatctgaaggtaaaaccttataacctcatcaatgttcagaagccttcgttccttcagaatatggattatttcatcactttccagaatggatattactttgtaagatatctgatgtggaactttgtaggaagacagaatgaccttgaaggaaacatggaaagcacaaaaggaaactggatttccggaattccttttgtcgataatgctgtggtaggaaaccaggataaaatgcctgcgaagtttaagaatgaaagcacagtgaaattcttcttccttccattaattttaggtttaatcggattctttttccaattaaacagagacttcggaagattctatgcgttgttgtctttattcattttaacaagtgtaggaattatcttctatacaggagtaaagccttttgagccgagagaaagagattatgcaatggtaggttcattctacgcatttgctatctggatcggtgtgggagccggagcaattttgtggttcctgcagtctaaagtaaaatcaaacggagccaacattgctctgggagtggttttattaggggtaccttttatgatgggcttccagaactacaacgttcacgacagaagcaaccgatacacagcgtatgattatgcgtattccgttttaaaatcattaccgaaaaacgatatccttttcgtgtatggtgataacgatacttacccggtttgggcaattcaggaaacagaaagattcagagatgatgtaaaggtggttaactttaccctggcttcaactccttggaaccttgaccagatcaaaagaagaacttacaatgcgatgggaatccctagccagctaacacatgaagattacagagatggggtaaacgaccagatctatatgatgaagaaagaagattgggaaggtgtattctctatgctgaaagaacagggagctcctgaaagtgaattccagtctttcagaaaataccttactcaggattctttaacattgaaacaggcgattgagttcatcaaattcaaatctcctgaaaaagatgagttattgaaaatgtattttggggaagagaagtttgaaaaatacaatatccttccggtaaacaaattcatccttcctgtcaataaagaaaatgctttaaaagctgggattatcaacaaagaagaccttccgaatgttgctaatcagatcatgattacttacaaaggaaacacattgtataagaataacctgattttaatggatcttttagcgaacttcgactggaagcgtcctatcaacttctcatcaggaggtatttatgacagtgagaatattttctatctgaatgattatcttcagtttgacggattcagttacagattaattcctatccaaacacctccgacagctgatggcgatatgggaagagtagatgccaattctctttataatgtggtgaaaaacttcagatgggggaacttcaaaaacttaaatgctcactttgatgaaacggcaacttctaatatcatcagctacagaatgtcggcgagcagagcggcagcggcccttgcattaagcggacagaaagctaaagcattggaaattctggatcttgcagcaaaagaaattccggcagagaaatataatgatccacgttcattaagttcaattgtttcaggatacatcattgcagggcaggagcagaaaggtcttcagattgctgaagtacttaaaaaaggaatctttgaagaatacgattattatttaagcctttccaaagcagaccaaagctacctgagaagacaaatgagaacaaaacctatggaatattctcttgtcgtttctgcagtaacagatgcttacacgaagatcggacagaaagaaaaagcatatgcttatctggtaaaatccattgagccgattgataagaagttcaatgtgtttatcaaagatcttcaggaaatgggcagagataaggcaatgaaagagtctgaaaatgtacagcagatcacgccattctatcagtacttatttgatgtcatggaaccttatgattctacttattcaaaagaaaaagaaagtcagatcacgaacgcgattatcaaagcgacaaaataaaaatactttaaaacggaacttcggttccgtttttttattattgggaatcctgaatattaagattatatttgtgaaactaaaaatacataatggctgaaacaaataatagcaggttcccaatctatgccgtaattgctacagttgcttttaaactcctttttttactgacacattatatccaggaagatgcatttattacctggagagttgctcagaatttgttggattatggtgtgatcgggttcaatggagacaccaaaatctctgcatctacaacacatttgtatgtttttgtatcttattttttcaaccttgtttttggaaaggagaactttattgagcctcttttgatttttaattcaatattgtttacgataggaactttattgctgtcccatttagtgcttaaaaacccctggcataaagcgatcttcatattcctgatcggtattttacctccggctattaaaatttcaattctaggaatggagtatggaattttgttctttcttgaaatgtcattattatattatggcttccacaaaggaaagaaatgggtattgacgtttcttccggtcttaattatgtttaccagaatcgatacggtaatattcctgggaattgtatttctggtagatgtattctggaacagaaaaatcagatggaattacatttttggcggaattctgggtgttttatcaacagtcgcttttaattggttttactttggtgaactggtgaacaataccattacggcaaaaaagctactttacagtgaagactttacgatccagcagcatattggttacttttttaagagtttcggaaacttctggggaatgctgaaagttcccggagattttaaccctgtcaccatagttgtattgatctttgagctgctttgctttatttatctgatcagacagagagaaaagagaaattactttttgtggatgatttttatcttcggatgggtaaaacaaattatttttatttctcaaaaaagcttatttgactggtattactgggttccgcagatcttacttttcgttcccgttcttatttttgtactggagcagaaggagagaagaaatctttggctgtccttattggttatattctatattttcccgatgcttgtttttcaaaccgttcattctattgctacaggaaatggagaatggaattacagaagaacgataggtatttttttaaatcaatatgaaaaagacaaaaaccaatggattctgcttgagccggcaggatatgttccttatttttcaggattaaaaacgatagatgaggttggattggtagataaacagattcaggaagaaattaaaaaggataaagtaaattactggatcaatacagtaaaaacaagaaaaccgaaatatcttctctcttacaaaaacctgtatgagggcaataatgactattcaagatattatcaaacccattataaactattgaaggaattccgggtgaaagatcacctgaaaagcgataataagattttagaaaaaatttaccatctgaaaccttccggaacagactataatttgtacattagagttgattaaaagattaaaatatttaaaaattgaaagcattcagaaaaaaagttttataataactctttcactctaatactctcaaaccctccaaccctccaacccaatataatccctaaaaaaatgaattactgtgcttttctccgcggcgtcaacgtaaaaggaactaacatgaaaatggcagatgtctgccaggtctttaaagatgccggcatgaatgaggtgagctcaatactggcgtccggaaatattgtgttttcttccgataaaaatagtgatgaattgaagacaattctggaaaaagcaatgtcagagcatttttcttatgaagcatttttgtttgtgagatctcaggaagaagcagaagtgttgtggaacagtattccttatgaaaagaatgatacatttcacatttatggctttataggaattccgggtgtggaaaaggttctgatggaggagtttcagaaagcggctcaggatgaaaatgaaaaagctgcgattgttaatggtatattttactggcaggttcctaaaggaaatactttggattctacctttggaaaagtattaggtaaaaagagccttaaagatcagtttaccagcaggaatgtaaatacgtttgagaaggtcttgaagaagatggggtaaaatattccatagttgggtttaatattttctgattatttttaagttttggctgaaaccaatggctgtttgttttatttgtaaacgggctaaagcccgttcctattgattttttaatctgcaaacagtggaattgttcacaaaaattacacagattctacctttggaaagtactgggcaaaaaaagttttaaagatcagtttatcagcaggaaggtgaacaggcatgagaaaattttaaaaaattctaaataattatcgcaatgcttcggcaggctcagcatgacaccgctaaaaaataacgttaatataatgtggcttcgacgtaggtttttgtacattgatggtttatactttgtattataattttcacattaataaaacagctagtattagagttgtcatgctgagcttgtcgaagcatctatcacttatcacttatccagtgccgattaacagttaggattagggttgtcatgctgagcctgtcgaagcatctatcaataaataataagaaatccaaaagccaaaaactattgcagccatagcctgttaaagcaatcaaataatttccatttgtgaaactttctcagtatttttactgaacttttaatgacaacaaaaatgattcagtatttagataatatttcgcacaaagattcaaaaaactttttccttattgccggtccttgtattatagaaggagaagatatggcactaagaatcgctgaaaaagtaatcagtattacggataaatataatattccatacattttcaaaggaagtttcaaaaaagcaaacagaagccgtgtagattctttcacaaccattggagaagagaaatctcttgaaatccttaaaaaagtaggagagactttcaatattcctactacaacagatattcatgagaatgagcatgcggcattggcagcacaatatgtggatgttctgcagattcctgcattccttgttcgccagactgatttattgatcgctgcagcaaaaacaggaaaatgtgttaccctgaaaaaaggacagttcctttctccggaagcgatgaagtttgccgttcagaaagtaacagattcccataaccagaaagtggctattattgaaagaggaaattctttcggatatacagatcttatcgtggattacagaggaattcctacgatgagagagtacgctcctgtgatacttgacgttacacattccttgcaacagcctaatcaaagctcaggggttacaggaggaagaccagaccttattgaaacggttgctaaagcaggaattgcagtaggagcagacggaattttcatcgaaacacatcctacaccggaaaccgcattatctgatggtgccaatatgttaagattagatttattagaagatttgttacaaaaattaacaagaattagagaatcgattttgtaattgttaaaaaaacattaattttagaaattctaaaacatttcttttgaaaaaactagttttaccgctaagccttatggtcccgtttctgattttctctcaacaaagaaaaaaagatacagcgaccactaaagtaaccgatatagaggaagttgtcttccagaaaaaagcaacaggaagaaccaatgaccttaccaacgtaagaatttcagcgaaagaagccaaatcagtagcttctattaatggtggaattgaaggattgcttaaaacactaccttccgtaaactccaatacagagctgtcttcccaatatatggttcgtggcggaaactatgatgaaaaccttatctacattaatgatattgagatttacagacctttcctgatcagaaactcgcaacaggaagggatgagtatcatcaatcccgatatggtttctacagttaatttctctgcaggaggatttgaagctaaatatggagataaaatgtcttctgctttaaatatctattatcgtgagcctgaaaaatttgaagtttcaggagaagcaagtttaataggtggaagattgacaacaggtttggcttcaaaaaataaaaagtttacagccttattttccggaagatacagaaataccaatcttgttcttaacactctgaaggaagatacggattttaacccgacctattgggatttccagtcttatctgaattatcatgtcagtgataaattctctatgtcattcattgggtattattccaaaaatgattatgagatgattcccagagcaaaaagtgttactttcggaagtcttcagcagcctattacggtggatatagggtatgcgggtaaagaaaatgaccagtataaaaatatgatgggtacattctctatgaactataagccagccgacaaatggaaacttacattggatgcttttgcctatcagaacagagaaagagaatactatacaatcaattcaggatatgaattgcagacttttgatcctgtgacgcagcagccggtaacatcgtttgacgtcggcggacagatagaacatgcaagaaatgacctgtttgtaagaacctatggaacccagttcagggccaaattttcacccaatgtaaataccgactttgaggttggatttaaatatgaaaaagaaaacctgaaagatcttaccaatgaatggaaggttgtagattctgcagggtacagcctgccaagacctgaaattattgatccgagaacaggaatgacaggtgatcttaaacttgcgtattatattgccgggcaaaacaatattgagcctacaagactttctgcatatgcacaatactcacagaaattctattggggagccagtaaagtatttgtgaatgccggagtacgtgtggccaactggagtttcaataaagaaacgatattctctccaagagcccagtttgcgattaagcctgattgggacagtgatatgttgttcaaaatttcagggggaatctattatcaggctcctttctataaagagattaaggatttagacggtaattttaactctaacataaaatcgcagcgttctatccaggttattcttgccaatgattatgagttccagatgtatgacagaccatttaaactgactacagaactttattacaagaaactggataatctgatcccgtattatatggataacgtaagaattcgttattccggacagaacaattccaaaggttatgcttatggtattgatacaagattattcggggaatttgttcctggtgtagattcctggttgtctgcaagttatgctagagtgtatgaaaatattgatggaagaggagatattccaagacctacagaccaaaggttgaggtttgccatgttctatcaggattatatgccaagttttccgtctatgcgtgtcaatcttactttagtctatgctatgggattacctacaggagcgcctgtcatgttcaacagcaacggacagccggattttggttcagcgtataattatcagcagactcttccttcttataaaagggtagatttaggattgacaaaggtatttattgatccgaaagaaaaaaataagagatccggtttctggggtaatttcgaagaactgacattaggagttcaggttttcaacgcattcaatattaacaatactgttgcaaaccaatggattacagattacaataccaattatatgtatcctgttccggtacgtcttacagggcgtttcttcaatgtgaagctagaatttaaactgtaaaatccactcaatcagaatcatctgaagataaaaataaaagatcctctgaaaaataattcagaggattttatttgcctgaaattttataactatggtttctctgataacccttatttttcaaaatgtacaatataataacaacaattgattgattttaaatcagttaattataaatttaaattatattgatggaataagtaaatttgaaggttagtagaaatgttatgagcaatattatatttaaaataaacgaaaagatagaaattaaaacaattaaagatttatttttcatgtccaattatttgccaattattgacatggatgatgactttcgtttacaaaaaatgtttgataatgcaaaccttgttgtatctgcctggtcagaaaataaattagtaggtattgcccggtcactatgcgactttagctattgttgttacttatctgatatttgtgtaaacaaagaattcaggcatttaaatattgggaaaagattaattgaaataacaaaagaacaggcaggaaaagaatgtaaaataattctccattcttcagaagatgcattaaatttctaccataaaattggaatgaaaagaatttcagaagcatttataatccaaagagaatattaaaatgagaaagcagcaattggggtggcaatggaatagttgaaaagttaatttctgaaaattttttgtttcccgaattttataacaacattaccaaattttataacaatcatattacagatatttttaactttgtcctaccaatgaaaaagattcttgccatattgttttctattttctacttcgggttttcttccggagcggcatttagcattcactattgcatgaaagaatttgtttccgtaagccagaaaacagatggtatctgtgcaaaatgcggtgttaaagataaaaaaggatgttgcaaaacagagatcaaagtagtaaaagtagatgattcccagagatcagatctgcttaaaattgactttttaggccagatttcagaagttccggttaaacatcagtttgctgtaattgataagtctttttcggcaaccaaatttactcagatccagatcaatgcgccgcccgaataccggccggtacctatctacatcaatcattgtaattttagaatttagaatccgtcagtcgtttccggtatcatcaattgtataccgttacgggcgacatgtcctgacgcatttactgatgcgttatccattcttattaaaagttaattctaaaatttaaaacaatgaaaaaatatatcatcacagcagccttatctttattctcaattatttcagtagcagcccaatctaaaaaggatgctcaggtctctaagctgtatcagaactatatcgctatcaaatcagctttggcttcagatgacgcagataaaacatcaaaagcagcaaacgaatttattaaaacagcttcagccatagactataaagttgtatctgaaggaaatcttaatattctcagaaaagatgcctctgctatttctgaagcaagaaccgttgcagcacaaagagaaacttttttcaacctttcagacaatatgattgctttgaccaaagagtttaagctttctgaaaagccggtatatgtacaatactgcccaatggcagatggaagctggctaagcgatgaaaaacagatcgcgaatccatattatgggaaatctatgcttacttgcgggagtgtaaagtcagaaattaattaattcttgtattattcttaaaaacaataagttgtatagcttgagttataattaaatttaagctatgcagcttctaaaagttcgaaatgttatgaaaaaattaataatgtttctggtgcttttattctctgtttttactttcgcacaaactacaaaaacgtattatacctgcccgatgcacccggaagtggtgtcatcaaaacccggagactgcccgaaatgcggaatgactcttgtgaaaaaaacagcagttataaaatccaaagtagcagcaaaaccggaaacgaaagcgatccctgcaacagagattaaaacaaaatctccagaaacaaaaataaataaggtaaaggaagcaactaagtttgagaaaacaaaagtaataaagccttctgttcaacctgagaaaaaagtcttaactcaagctcaaactgtttacacctgtcccatgcaccctgaggtggtttcagacaaacctggaaaatgccctaaatgtgggatggatctggtagaaaaagaagatcattcccgtcacacagacactgaaacgaaagaagaaaagtctgttctaaagcgtaattcagaaaacgggagaattactttcggaggaaaaacagttcgttatgatctgtatgtaaaagatacgattgtcaattttacaggaaaaaacagaagggctattgcaatcaacgggaaacttcaggctcctactttgtattttacagaaggtgacactgctgaaatctatctgcacaatatgcttaaggaaaataccggattgcactggcacggagtgattcttcccaatgaacatgatggtgttccatatcttaccacaaagcctgtaaaacctggagaaacccatttatataaattcagaatctctcaaaatggaacctattggtatcattctcacgaagctcttcaggaacagataggaatgaacggtattctggtctttaaaaaaagagaaggcgaaccgaaaacggagtacaatgctgaaattccggtattactgggcgattggagcaatgatgatccgatgcagatcgcaagaaggcttcatatggcgaatacagactggtatgctgtaaagaaaaatgcagtacagagttactgggaagccattaagtccgggaatttaggaacaaaagtcctgaatgaatggaaaagaatggaagcaatggatgtaagtgatgtttattacgataaatttttgattaacggtactccaagttcagattattccaatttaaaaactggtgacaaagtaaggcttagagttgcgaatgggggttcttctacctatttctggctgaattatggaggcggaaagataaaagtagtgggaaatgacgggaatgatgtggtacctgtagaggttgaccgtctgattgtaggagtttccgaaacctatgatattgaagtgaccatccctgaaaataaaagctttgaattccgggcgacctcagaagacagaataggacacgcttcactttggctgggttccggtgaaaaggttgaagctcccaatcttccaaggcttatgctttttgaaggaatgaaaatgatgaacggaatgatggagatgagcgggaatatgaagcctatgaatatgacgatgggaaatcagatgatggatatgaatgaagtcatgtatccggaattatctgaaaatcaaagaaaaactacaatgaagcacattaatgagatgatgggcgtgaaaacgaaggaagacaagaaggaagatcattcccaacactcaggcatggatatgaaggaagaaaaagccatcaaaagattgtcttacaatattttaaaatctcctgaaaaaaccattcttcccacagacagtatccgtgaaatgaaatttacgctggaagggaatatgaaccattatctgtggactttggataacaaaaccgtaacagagacagataaaattctgatcaaaaaaggagaggttctcagaatcaagatgtataataattctatgatgcgtcacccgatgcaccttcacggtcatgatttcagattgatcaattcaaaaggagaatactctccactgaagaatgtagtggatatcatgccgatggaaaccgtaacgatagaatttgcagccaatcaggatggagactggtttttccactgccatattttataccatatgatggcgggaatgggaagaatcttcagctatgaaaattcaaaacccaatccacaacttccgaatagaaaattagcctggaaaaactttatacaggacaataaaatgacgagttctatggcaatgctggatgtggcaagcaataagattcatgcagaaaccatgaccatgtttgggccaagatgggctaaccttaatgagtttcataccaactggaattttgatcattttgaaggaagtgcaaaagtaggacgcttcttaggaaaatttcaatgggcattaccttatgcaggaatcaggattcagaagaatcatgagatcatggagagaaagatggcagaagatctgggaatggattttcatggcaaaaagacatggttcggacagcagaaagcctccagaaacaagtttgcatttatagtaggtatgcagtatgtgctgccaatgttgattactgctgacgcaagtgtggaccaaaacggaaaagtattactggaattgagccgtgaagatataccgctttccagaaggctgaggggaaatttcagtgtcaattcagatggtgagttttcaaccggagtgaggtatattcttcaaaaatggttatctgtttccggaaattatgataatgaactgggctggggcgcaggtgttactttaacctattaatttttttaaccctattatttaagaaacaatgaaaaatataataaccatactgtttgtgggggctacattatactcttgtaataaatccgatactacaatatctgaaaagaaagcagagccggaaattaaaacgactggcaaaactgaacctgctgaaatctcagatcagaaagtacaggaaagtccggaagaaagtaaaaaagaaacaaacaagctttcagcttttccgatccagcaaattatcaaaggctaccttcctctaaaaaatgcactggctcaggatgattctaaaaaagcatccgatgcggctaaaagtctgttttctgtattaaagaaaatagacatcagtaaaaccgatgctaaaaggaattctgagttgcgtgatattttagaaagtgctgcagaaaatgtagagcatatcattgaaaaatctgatgatatagcacatcagagagagcatctgctttccctgagcaatgatatcaccgatttaataaaagaacagggaacaggcggtctgaaattataccaggatttctgtcctatgtataataacggaaaaggagggacctggatcagtgaatcggaagagattatcaatccatatgaaggccagaaaatgattaactgtggctctgtaaaaaaagtattttaaaacatacaaagagatgaaccggaacattaaatatatatttttagggtttgttctcatttttttgcttattcaattcattcagcctgcccgtaatactgattatgggcaggtaccttcaacagatatttcaaacgtttataaagttcctgagaatgtacagtatgttttgaggaattcctgttatgactgtcacagtaattctactcattatcccttctattcctatatacaacctttaggatattatattgaaaagcatataagaaagggaaaagaagaattgaattttaatgaatggagtaattacagccgtcgtaaacagactcataaattagaatctgttgcgaatcaggtacagcagaaaaaaatgccgcttacctcttatacttatcttcatccggaagttgccctttctgaaaatcagataaaagagatgattcgctggatagagttggtgcagactgaaaataataaagcaaataagaattaaaaaataaaaagccatccgtttacagggtggctttgttgatagaaacataagtgtacagcttgtactgactatatagtttaacttttttcttttggtctttaatttaaaatgataaaatataactctccgacacctttttgaaaccatatttactaaaaaagttgtgagcgccatgattgttgactccactttctaataagataaaactgatgttccagcttttagattcatgaatggctttctcaagcagcttgctcccaagggattgtcctctcacagactgatccaggagcatatcttccagaatggcatattttttaaaaggactgttgatgacgttaaaaaccatcatgccgacaatttccccgttttcattttctgcaatcagaatattcagtttggaacttccatcagaattaaaatcggtgatcagctgctctgtcagaatcagctcaagatcaggattccaatggtgtgaatctatcgctctgccggacatcatttcgccatgagaaatatatgcatctgttttatgggtaataaaaaagtcgacaagttctttcacgcggcttttatcggtaagccattgggtagtatatttcataagctgcagtgtatttattttaattttttcaattcttccagcaatttattctgcttgttgataaattgattgagactgtctgttttcagagggtgagccttttggtatttttcaatttcaggaagcgtctttctgatcttgaaggcagcgtataagctgtaaatactttgcttgttacgattaattttatgcttaagatcttttattatttgaactttttgataataatcattttgactttcctcgatgagcttaatcatttcctttcttaaaaccgaatcattaatagattttgcttcattttttgcaatcaaataataatcttctgaattagaaatgatgctgctgtatataccttgcattttatgagcatcttcttgcattaaagatattttttcatctattttcttaatttctttatcatttttgattttttcatcatagatgccattaaatatatcctgagctttgcttagtcgttttacaggaatactggattctgtgttctcagctgctttttctacaatatcattttgtgattttttttcactgcaggaaattaaagaaagaaccacagcagaagcgaaaaatatttttttcatagtttgtttttataggtgcataatcaacattatatcccttctaaaattaatcatttagattttatcatcagtgattaaaggatatgaatttaattagttgaacaagctttgacaaatgttacatccaaaaaaaaaacggagcctgaaaacagactccgcctataaaatttttacgctaaaattatttacccaggtaagatttaaggatcttgcttctggtattgtgttttagtctcttaattgctttttctttgatctgacgaactctctctcttgtaagatcgaaagtctcaccaatttcctctaaagtcattgggtgttttccgttcagtccgaaatacaatcttactaaatcagcctctctaggcgtcaaagtattcaatgctctttcaatctcgatttgcagagattcaagcatcagatctttatcaggacttggagattctcctgaacgtaatacatcataaagattagaatcttcaccttctaccaaaggcgcatccatagacaggtgtcttccggagtttttcatagattctttaatatcttcctcgctcatatcaagaacttcagccaattcttccggagaaggtggtctttcattttcctgctcgaggtgagcgtatgctttattgattttgttgatagatccaatcttgttcaatggcaatcttacaattcttgactgctcagccaatgcctgtaaaattgattgacggatccaccatactgcataagagataaatttgaaacctctagtttcatcgtacctttttgccgctttcattaatcctaagttaccttcattgatcaaatcgggtaaagaaagaccctggttttggtattgcttagatacagatactacgaaacgaaggttggctttgattaatttctccagtgcggctctgtcgccggcacgtattctttgtgccaattctacttcctcgtccgcagtaatcagttccactttaccaatttcctgcaaatacttgtctaatgaagcagtttccctgttggtaacctgcttagtgatttttaattgtctcatttattttcctcaaaaaagagttactataatatatacgtatgaaaaggtaaaaaggttacacaggattcagtttttttgtacaatgtacaatgtaaaaacgtattaataatttttagtgataatttaaattattgataattaatcttttagatatatttatttttgattttaaaatatacaaactttataatttccctaaaccctaaaccctaaaccctaaaccctaaaccctaaactttaaacaaaaaaaaacgaaaccgaagtcccgtttttatatctaaaagtactatttcaggttatattaggttatccgcaaacccaaaactagcaactcgtaatctgcaattagaaaagttcgttcagcactttcgccagtctcaatccaccgtacaataattgtctttccattgtttcattaaacttgtactggtagtcgtaagataatttagaatcgttaggagtctgtgcatagatcttattggcgattttgtgagaatcgtacaaccagtcttccagagttccggcctgaatctttgctacttcttccttggatttaatatctaaaagcttagaatattcagtgtagctgtatttttgagaatctacaagttttccatcccaaacagagtgtaaattcgttttttccccgaaataggtaacattgattttgtttcctcccaaatcttcagctcttcctacgtgtagcggctgtgcaagatctcccataatgtgaataaggaagatcaaagcaatttttctgtctttttcagaggtatttttatctttgatctggcttgataacgtgtttacctgagtataaaggcttggtcctgcctgtgcttttaagttttgttcaaaagccttaaaatcagtcatcggatcaatgtttacataatgccatgatgaagcctgtttccatgcacctgtcgtatcagatttgataaaatccggccagttcgcccagtaagccagacgttctttccccataatctttttaatctcccttcttgctttacgggaaaggtggttttgtgcaatgtctgcaatcactctgtgtcccgttaatccccacgcataagaataaagtgaagaggccatgaatgctaaaatcagaattttagaataaatacttttcattttaaataacaattttcagtctgcaaagatacggcccgctttcggaatgagcatgcattatcctgaattaattccataaagatgatgttaataaaatttaatgtaaataaaagtcgcaattatggtaggtttgaaggcttaaaacccagaaagaatatagagtaacaggatgggggtagatattatatgataaagttttttagagattgagaataattcattccaactttaaaatgtagataataaacgttaatcatctgatactgaaagaataattttaaattcagaaaaacaaataaaccctttaattcccgtatttttacggaatttaacggaaattattccttttaatgtcaataaattagtatttttaaaataaaattattgtcaaaatattttttcaaacttaagagatatattatctttacaagtcataatcagaggaaacactatgtatgagaataatattgtagatatgcattacaataagctgcagacagactttaaggctgaagctgtggcagttaatcttttgaaataccatcgtgcggtaagcaatatattcatagagcgtgtcggcgtaaacgaccgtgcttacctgaaggatatcaaaagtatttcaagcagttatttaggatttgatgaagaagtatttaccatagagacttacagggagggtatttatgactatcttccggaagggttgttccatccgccgtctctgggtgcttccagaaaaaatgtagattctgtggtaagggaaatccgcagacaaaaaagagtggaagatgatgcgcgcaaatttttccgtccttttgaactggaggttttctttacggagatcagtgctctgctaaaagaatctgagtttgatattacgagcaatacagattctttattagatacaataagtgaactttggcctctgataaagatgctggataagcagagtgcctatatttttatgcatattttacctttcttccatcagatcagaggggacaaaagatggttcgaaagatgtatgacagcttttctgcaggtaccggtaaaagtaactttttctcccaatatcattgatgaaatagagaagaatgatgattccatgctattaggaaattcacgattgggagttacctatattcccagcgggccgcatatggacggacagcggaactgggtagtgaacattggtcctattccttacagagatatgaagaggtatatcccgggaagtccgttcagaaatgtacttcaggctctttatgattattttcttccggtaactgtagatgtggaagagaattttgtcacagaaaaggaagaatattccttcagtcttgaagacgatgaaagaaatgccagccgccttggatactctacattcctctaaattattttactatatttacaactaccaacaaagtataaattcgaaaagaaacaaatggaaatttcttcagtaaaaggtatttttttaaggtatattttaatgcctttaatcgcaattattatgatggttatactcggtgtaatcaggagaaataaacctgcgataaaaattaaagtaattattgtatacgtattgctgtgcagcttatgtctggctgttcctggttttttcggatttgccggaaatctttttaatccgtactggtatcttattgcacaggtgatctaccttattttagggattattcacgtgaaccttttacataagtatttcaaaaaacatattgattcccttgcgatgagcattctgtttgaatccatactgtctctgacatgtattgctttgggaggatacctttttaccctgctctttaagtggatgagtaacggattgggaaatggggtaatggcagcaactagtatgctgatttttgtggttcctatggtattttactactgttatatccagtttatcagcattccttttgatatttataaaacatggagatattctccggagcagaaactgcctgattttgaaggagcagattttgacagattaatggtattgaatgttgaactgagcaaaaaattagaagataccaaccgtttcagaattaaagccaaaacacttccgacaggagtgactttcggagactggttctacagggtggtagatgattacaatcataaaaatccgggttcaatcatacatctttcagacgaaggaaatgagccgtattactggatcttttacaccaaaaaatcgtttttcagctttagaaaatacatagatttcgaccacgatattacaacaaacaacatttctgaaaatgaagtggtgatttgtaagcgggttattcagcatgaagaggaaggaattgcaagaaaatcataaacacaaaaaattaaaaagtattaaacatgatacagcctattaaacattttgcgatcaattgggtggacgggatgaaagtttcccagagacaccttaatgatcaggataatttcttaattgataccatcagagattccaattcccttggaattactacatataattacggacttctgcctatttccaatgaatttacagaccgtaccatttttgatgttcacaacacggcgaccaatgatgtacagcttgtaatcaaacgttgcagcgctgtgacaatggcagggtaccgtattgagcttacagacagaagaatcagtgtgaagtctttggcaaaatcaatgaatgaagagcaggcagatggggaatattatattctgatctctgtaaatccttttgataaagtacctttcggagatattgatcctgaagaaattccgccacgtcatccaagtgcacagcctaatcatcatattgagctacttcctgtaacctctttgaacagcagttattcaggaggaaattaccttatcatcggaaaggtggatctcaaaggaaatattgcccaggtagattccaactttattcctccatgtacttctgtacagagtcatccggctttggtagactactacagcagttatgcaaagtctatcggaaaccttcagcagtatgcctttaaaatcattcagaaagcgtcccataagaatcagaataccgctttggcacaaaacgtcaagtttctgtgtacaacaatgatcaatacttttggtgatatgtatttccagttcagaaatattacgccgtggcagccgcctgtatttttgattgagtcttttgcaagactggcgcttcatttatacaactcaacccagcttcttgttcctgcagaactggaagaaatgctgaactacagtttagagtggagcgaaattgcccctcatactttactgaatcagctttctattgttgcagaaaccaattacgatcaccacaattgtggagaaccattactttacattcaacagatgctgagaagccttgaaaccattttctctaagctgagcgagcttgattacatcggtcagagaaaagaaaatatcattgttaatgaacaggaagtttctaccaataccaatcctaagagaggttggagtgttttagattaaatcatttattaaaaatagagtcccgggtgaaaatccgggattttttatgtccaagatagaaaaaattaaaagtaaatttgttgtaaggattgatagaaatgaatttagagattatcagacaggagacgcccggatgttcggataaaatatttttaaacagcgcaggggcatcattaatgcctaagaccgttacagatgctaccgttaagtttttatatgaagagcaggagttgggaggttacgcagctgccactcggaacacagataagatcggcaggttttatgaagaggctgcaaagcttatcaatacaaaaccttccaatattgcatttgtaagcagttctaccgatggctatgccaaagctttgtccagtattgattttaaagaaggagattgtatcattacgaccaatgatgattatatatccaatcagattgcttttatttctctgcagaaaagatatcatattgaaatcgtaagagctaccaatctttctgaccatgagcttgatctggaggattttgaaaacttaatcagaaagcatcatcctaaattaatcgcagtcactcatattcctaccaattccggattgattcagaatatagaaggagtagggaagttgtgtaagcaatatgatattctttatcttgtagatgcctgtcagtcggtaggacagctcgtggtagatgttgaaaaaatccattgtgattttctgacggccaccggaaggaaatttatgcgtggaccaagaggaacaggttttttatatgtttcggataaagctttggatagaaatatgtatcctttatttttagatagtatcggagccagatggtcttcctttgatgattttcagcttaatgataccgccagaagatttgaactttttgaaaggccctattcagcattgctgggatttgcagaagctttgcgttatgcgaatacgattggtatggataagattgaaagttacaatcatacattgtcagggactttaagagctcatcttcagagtagtggtttcaccgttctggataaagggaacagattaagcagtattattgccttctgccagccagacggagaggttgaaaaaattcacaaaatcctgagtgataacaatgtgttttttaaggaaaaccggagaggagatgcattaattgattttacttctaagaatgtggaacattcaatccgtttgtctcctcattattttaatacaatggaagaaattgaaactgtatcacagcttttaaaaagtatcagtcattagcatgctgtttaaatatttcgggccccggcattcgccggggcccgaagtatttattttttatttaaaagatcaagtgtgtgctctacatggccgccgcctttccattcatcatgtccgggaatgatcagggttgcctgagcgtatttggattttaacttttccattgtttttggccattgtgcaacgttggcttcgccggtgtatccaagatcggttgctgctttactttttacaagacaacctccgtccagtatcttatatttgggaaaccaaaccactacattatccgccgtatgaccttcaccaagaaagtctactacaaattcttctccaccaatacggtaaggtttaccggtttttataatttctgtagaagttgcttttccttctttctttaaaatttcattggtttttgctgtagcgtaggttttgattcctttgttattataaaagcttaaatctccggctctgtcttcatgagaatgggtggcaaataccacaataaccggcagatgatgacgtttttgaatggtatccatcaggctttggtattgtgttttctgccatggaacatcaaacaggacaactccttttttagtcaccagataaacggcattggtagaatattctttccctccgaatactccgaaagttttgtaaatataaaagttaggtttaatttgcggctcaattacaaaatctcttacctgtgtgtcctgggcgtttgccaatgggcttagcaacatcgaaataataaaaaacggaatgctttttttcataatttttgagtaataattaatgtttgtatttgtcagaaaagacaaagtctgcagattgttttgcaaacctaattaaaaataaatctttcgactttaaagagatggagtttaaccgttttttaacagtttaaggaataaatgtatttttccaggtaagtgcagattggtataaatagtaaacctaacaggttttaaaaacctgttaggtttatttttcagttttaatgatttatttcttaacgagtatcttctcagtagcttttttacttaaaacctcggtcttaccatcaatttctattgtcattgacatatcaaaactttcaattttaataatctttactttggtattcaggagaagttttctgtcattcaggtaggtcaggaaagcatcatcggaaagggtaacagatgcaaaagttacattttctcccggttcacagctgcttaatttctgcagatcctgggctatgatgttcccatctttatcaggaataggttctccatgaggatcgaatttaggatgatccagaatttcatccattttgtcaaaaaagatttgagaatgtacatgctcaagctgttccgcaatctcatgaacattttcccagccgaaattcattttttttaccaggaacatttcagtaagcctgtgcttacgaactacaagggcagcttcccgtcttcctttttctgtaacgattaagggtttgtaggtctcataaatcacccattttttctcggcaaatttcttcatcatgttattgacactcggcatttttacatttaaaaatttactgagctcattaatcgtaacctttccttcattgtcaactaaatgaaacaaagctttcaggtaattctcttctgttagggttgttctcaaaatgttagatgattttcactacaaatctaacaaaataaaatgaaaagtttacgcttgttattttaactttttttaattttactctatgaaattttcattcaaaaacgactattctgagggatgtcatcccactattttacaagctcttttacagcataatcttgaccagcaggccggatatggcgaagatgaatattccttaaaggccaaagatttaattaaggagaaaatcaataatcagcattcggatatttattttgtttccggaggtacgcaggctaacttaattgttatttcttcaattttaaaaccttatcagtgtgtgatttcagcttcttccgggcatatattaaacaatgaaaccggagctattgaagctacggggcacaaagtgctgagcattgaaactgaagatggcaagctgagaccgtcggatattattcctgtgctggaaaatcataagaatgtgccgcatcaggtgatgcctaaactggtttatatttccaattctacagagttgggaacaatttaccttgcgaaagaactggaagaactttctgttttctgtaaacaatataatttattcctctttatggatggagcgagattgggtcacggcctgacttctgaaataagtgatcttacgctggaaaaagtggcggcccttactgatgttttttatcttggaggaactaagaacggagctttgattggcgaagcgattgttattaataatcctgttcttcaggaagattttgcttttaatatcaaacagaaaggagcgttactggcaaaggggagacttttgggaatccagtttctggaactgatgaaaaataatctgtattttgatattgctcagcacgctaatcagcaggctatgaaaattaagaaagcattacagaaaaagggaactgcttttcttgcggatacttataccaatcagatttttcccatcttacctcataaccttattgaggttttgtctaaggattttgagttctatgtctggaaaaaaatagatgaaaatttttctgcggttcgtcttattacttcatggagcacaggagatgatgctgtgaaccggtttattgaaatgatagaaacagaattagcataaaaagaacagccttgaataaggctgttttttatttataattgatttttattttaaagctttgctcactactttacaatctgcagtgttcagcttctgtccgtctttatagctgattttcttttcgtcagcatatttggtctgtccatcttcttctttatgatcgccaataccttctgttaaagtattatctttctggatgaagtaaatatctctcttgcttttcttaccttcagaatcaaattcataggtcagcttcaatgtatctcctgatttaaaaccggtaacatctccttttgaactgtctttttcactgtttttataagataatttcccggtgatcgttcctaaattatcatcaatagaagcaaaaacactgtcttttcctgtaaccccaatataacagaatgattttggaccaagcgtatctattacaggctcttctgcagcaatcgtatctgctactgctttgggagccggtgcctcagtttttttattacagttgattaaaaaagctgatacagcgcccaataagattaattttttcatatccttaaatgttaaaatcaaatttctattctgctaaaataacaatagtattcgtatattaaaaataggatatgaagagataatgattttatgatgaaaattaatatttcagaaaagagttttaagaaaaaaaaattaatgctctcaaacataataaatatttttaggcacggaaaatgatctacttttttaaattgatttaatgaaaaagataactaaagtattgggtttggggctgtttattctaaacttatattttgtgactgcacaggctcctcagaattatatttacacttcttcgggagatctgcatgcaattgaaaagatgatcacccgtaaagatattggcggagtccagattgtttataactggaaagcactggaaacttcaaaagatgtgtatgatttttctgttattgagaaagatctcaattatctgacgggtctcaataaaaaattatttatccagcttcaggaccgtttttttgaaccacaggcaagatatgttcctgattatatattgaaggataaagaatataacgggggattggtacctcaatatgacaatcccggggagaataaacctgtaggaagtggttgggtaacccagcaatggaatccagctgtccgggatcggtttcagaaactgattggagaactggcgaagaagtttgacggaaagatccagggaattaattttccggaaacttccattgatatagaaatgaaaaaagataagacaggtttcagctgtgaccgttattttcaggctgaactggaaaatcttaaatttgcgagaagtgctttccgtgaatcctatgttttgcagtacgttaatttctttccctgtgaatgggaaaatgaccatcaatatatgtccagactgttcgattttgcctacaaaaataatataggattgggcggacctgatattgttccggataaaaaagcacagatgaagaattcttatccttttttcaaccaatacaaaggaaagctttctttggtggctatggccgttcaggagccaacgttaacgtataccaatccgaaaactaaaaaaccttttaccaaagaagaatttacagcatacgctgaaaactttctgggcgtaaaaattatcttctggagtgtggaatctctctggttgagagattcctgattgttctgataaaaagctgggtcaattctctgctcatacttttactattcctctgaatcctctggcagcataataagaatctgcaccgttgtgatacataaatacagtattgtatcgtctgtcgcagaaaacagcccctccaagttcacggatttgtggtggtgttttgatccagcttgaagttttttgatcaaattttcctaattcctgaagatgacggtattgttcctctgtcaaaagttcaattcccatttctttagctttgtcgatggcgttgctttccggtttattggcttttctggcattccaggctggataatcatagcacaggcttcggcgtttcgggctttccggggagcagtctacaaaagaatattcatctgtttttttattgtagtctactacgtcgggttcaccttcagtaacttccatttcgtataaagactgtatcttttctgggctggcttccagtttttgttggattctttcccatttcaggtctttatgacggttcatgtttttttcaaaacgggtttttagtgtttttaaaagctcgttgatttgttccggggttagtttatttttcatgccaaatttttgttttatagtgtagtgttgttggaaatcgcaaagacgcaagttttgttaatgagggattgtttaaggcgcaaagattttatctgcgataaaatttctttcttttttactcttaaatgattttaataaaaactgtttaacctatcaaagaatgttcagtatatattgaattattctgactttaagcttaaagcgaagctcgtcttcatattctaaatagcttaatacaatcttaatgtttcaaaaataaaagtttaaacaattttaatatcaaaataattaatcaatgatagtaattttcctttctgcaggtctgaagtaccaggaaataataaccaatatgaataataatactgcggggaaagttctgccagctgtgtcacccacaataagatgggaaatgacagctccggacattacaaagaaaaatcctgcataagcccattcttttaaaagcaaacgtttaggaattaagatcgcaataacgcccagaattttccatactccgatgatggtcatcaggtaagaaggatagccgagattggtaaagttggccagttcatctttgtttttcattagctggacaatggctgttgaaaccattcccagagccatccagagggtgaatatccaatagatgatttttgttcttttttgtgaggggtgtggtgtgttcatgatctgttttttatagttagtcgtttaatcctattccatccatgatttgtggaatgcatttttcaatgcgggcttcgcgggttttggactgtttggcagaggagaagtgaagcaggtaggctctttgtcttcctggtgttaatgctttaaaagcttcctgtaatgcaggattttgatccagcttctcctgaaactcttcagccatttcaaactcttttgttttcttcatttccactttagcgcctgattcttctatttcaacagcttcaaacatatattggcgaagaatgtcttccagatcattaatttgttccacatcagtaaaacggatctgccttgcagcctgcacattttcggtctgctgaatcaggatatggtccggatctttcatcaaggcccctttaaagaagagcagcgcacaatattccttaaaaccatgaatcaggaaaatatttttcccttcataagtataacagggacagccccattttaaatcttcaaccaattcggtgcttagagcgattgttcttagcttttcaaattcttctttccactgtgtggctttatcgaagaaaaaattcacttttggattcattgtgtggtatgtttgagggtttgagggtttgagagtattagagtggaagagttttgggtttcgggatgcgagattcggggtgtttaggtttgaggatttgagagtgggagagtataagggtttaaggtttaaagtttaatgttcaaggttctgttgtttattaaataatgattgacgattcacttgcgaagcaaaattcactatgacattgatgcccacaatttaaaccttgttgcccattgtctatcatctcttcgtctattctcttttcgtctctctaaacaattcctgcaaacggttatgcgccatattaataccttgggcgaatggcattttcagatgctggtctctgaagtctacagatttataaatggtctgaatggttattttactggtggcatccgttaatttttcaaattctaaaaactcgatctgaacgggaaaaggagtgttctccatctgaaaagttcttataattttctcattctgaacaatatcatgaatggttccgtttgcactgaaaaccacatcgccctgaggatttaaagtttcgaaacggtaacttccatgcggtttgttttcgaatttggttactttcgttctcatccattgcccgaaaagttctgcttctgtataggctttgaaaagcagttctacaggaaggtcaaattctctgatgatgaagatttcctgtttgccgtcttctgcgtgaatttttgttttgagttccatattttgagtttgagggtttgagagtgttagagtgggagagtattagaggaaagagttcaaggttttatgtttaaagttcaaggttgtcattctttcactggtgattgacgattcacttgcgaagcaaaattgactattgacattcgagtttaaggtttgaagtttaaagttcaaggttgtcatcctattcactgataattgacgattcacttgcgaagcaaaattgactattgacatccaccagttaaattttgatgctcttgtctattatctatccgtctatcatcttttatgtcttattattcacattctgatacgctttcatcacactttccagcttattgaatttctcatcccacattttgcggaaaggttctataaaatcggctatttctttcattttattgggattaaggtgatagataatttctctgccgttttgttcagatctcagcagttcgcattctgtaaggatctggagatgctttgaaacggtaggccttgccgtatcaaaattggaagcgatagctcccgccgtcatcgactgtgccgccaccaacatcaatatagaccgtctcgtaggatctgctatcgcctgaaatacatctcttcttaaattcattgtgtagttatttgactacaaatatatgtgtagttatttagctacgcaagttatttttgagaaaatatacaataaagtgaggtattctaataaaaatttattcgttccttagtcttagtttttcgagtatttcattaatatgattaggatatttatcttcaaaatattcaaagataagtggatttcctgcaaaaaaatgactacaaaacttaatccaagtgtttatgctcactataccgttcatcttgaaaagtttctgtgataaagtttttatatgaccttggttcttattgttgtaattgaaatctgaatcacgtcgtgcataatattggttttcattataaaaatggatagccccatcaaagtgcctgaaatatcccttttgcatatcatattctgcatgaatatatcttacaggaaaatattcaacattattttttattattttaatttcctcagttttaaattcttccgcctgaaaacttttaatattatcttttgtagtccatttaatatctaaggaatatgcatttctaaagaaagatgaaatatatgtatattcaatatccattggtggacgcaatttcactattccatcaggaattaaatcaattttattattgaattgagcaccataccatgtatcaagctctaagcaaggagaaccattaacatcaatccttactctatccatatcaatagatatataatgatctacattagtgtcattagattcccaaaagtattcaataaatcttggtgcatagttatttatttcatgaaactctctcctaaaatatgagttagccattaaaacaaaattttcatgaaacaagtaaccattgaaaaatgttttttttacgaatgttttattaagttcatcaaaatttattaatccgtctttgtctataactagatcttcaaccaaaagattaacaatattagggaaagatacaataatgccagaggtttgataaaaattaaagttatcatcagttaacttaatccctttatctttcatgattttcttgaaatattgaatttgaggtttatacttctcaagttcttctttttctatttctcgaagagcttttagatattcttctttaaaattatccatctcttttattatttatctattttgaaatattcttcagcttgtacaatcatctttaaggaaagccaccaaagataaataccgtaatagtttatttctaatggagaaattaatccatgagatattttgttcctaaaatttacactattaccatctattaaaaagctgtttaattctaataataaatttttttcacaaataccatcaagcattttcccattttcttttgtacttaatatgcctcctagagtattgtcattctgaatatcttctgaaagtaatatcgtgtttctattgttagattctatgatagattttaaactattttcaatttgaggaataaggagatgtgatgcaagtataaaattattctgaaatccactgtaaatcccttcaatgaataaatattctctatcttttgaaatgaatgagctcttacatttgttaatcatttctgctacccaatctttggatacctgtccatccaaatccattataaatttaatctcttggattaatgaaattgtaatatttctataatattctctttcttggtttagattaaactcttctgtatttgaaataccactaacagttcctttatttgtaatgtggacacttgtcggaaaatatcgttgataaaaattattgttttcttgctttttaataaaagtaggactaaaaattggacaccataatagaaaattgaaaccactataaaagtcgtcaatattttgttcttttattagctgaggaatatttaattttgatttgccagtagtgccaattattgatataatttctgcttctattttttgttccttttttatctttttttcaagtctagttttaaaacttttatctacaacaattccttttatttgttttagagcatcaagataagttgataatatgtttgggttatatgtattttcgtctttttgagacttataataatctgcctcttcttctaaacataatgctgtctctattttgagttcattatgattaaagtgccctaacttatttaacccctgaatataattaagagcattgccatactgatttgcttttaaactttcttttaatttaattataaaataatttttaagcttttctgaagaaacttcttgaattagaagattgatggaagcacttaaaagttttaattgataatatgatgattctaatctaaaaattatttctagtattttctcttctaatcgtataagatcttgtttaaaaatagattttacttttcgtattaattctagggaacgaattagataatctaattcatcagtcctttcatatattcttatataggagtctacagcattttttatacagtttaatttgtccttgtccccgagaataaattttatatcattaatcctagctgatatctcaatattgtcaatatgtatttcaggtaaaatgaacttagggtcttttaaaagattttcaatgctgtcctctgtaaggttgcagttaatgagctgatataagctatttatttgtttatctgtagaattgcttttccaaaggttaaataattcaaatcttagttcttttgaatacttgttgttcaggatttcttttgataattctttcatttcaaatatgatagctgtaaaatataaactaaggtatgtatgaatattgggtttatagttctatcatttgttcgtttatttcactaacaaatttagttgttgcagtaatcagctcttgaatttctttctttcctatattatgttcagttgatacctttgtctccttatcaatcttcgtttttccatttcgatgaactatatcatgtcttatttcaattgctttataaatagttgctttatcacttgggaatttgattgtaaaggtatccttaaacatttgattaactgtagaaagattatgatatattattcctaaaatttcatcagtaacaatctcttcaattttattatatttcacaaaaatttcagacagttcgaatttttgtgaattgtctttgcctttaaattttggataagtttccacaaatttttttaaatataaagtattttgaaaaatagtatttataaaaatatcagctaaataagtttctagagaggtaataacatttgcatataatagatatgctaccaaattgtctccggaagaatcttcattcaacttattagtaacctccagtattttattgatattatctttaaaagctatgaaaatactattacgatctaactcaatatttaaattaggaaatgatgattgaatttgttgaagatttccagattttcttcttagttcgactaattctggtctgtttaaggcaaaagtagaaatagtgattttccctttctctgtttttccttctaataatccagaattaatatctaaagtaagatgttcttggggttcttctattgaaggatttataagcaatggcatattgttttcatcaagaggaaacttatcccttttaactatattacaaacctggcaacataatattaaattattccatttgaaagcttcttggggatatttattttttgggtaaaaattatcaatttgtggtaaactggttatatttaaatctccttcacaatatccgcatttattattgaattctttaattaaatctggacgaattctttcaaagtatttataataattatctttactaaaattaaaatctttaaaatagtcaggttcttttcgagcaataaatttcatatattagttttattcatggtttagttattatctattcattgttctctcattatatcttcgtaaaagctttctattccatccacataatcagtatatttagcaaaaacatcagctgtgtatagaaatagtgtcatgcttttctcaagtaattcagcaacatcaattaaatttattcggtcattatttttaaatgatggattttgttttttatcaattggatatctaaaagcatcagaatttttgtctaaaatatgaagagtattatttaatttttcaacctcgtcacataattgtttgaaagattttttatcttcatcttcaatatcaatattatgtttgctttttaaattttcaatagttttttcaacatgcattttaaaagcattgaatagtttttcaaggtcatgtgttcctgcattggtataatcatctttttctgaatactttgaaaaatatcctatgtttgcttttagtcctagctctaagcaatgtctagcaatgaatagcattggatatgcaatatgatcaacatgagatttggtatttacaacattatttagtaaaatatcaaaacttcggttataactcccaaggtaactagtaaagcttagatattgatctataaatgcattgaattgatgttcagttctattatttctttctatgtcatattataatacttacttctgttgtatcaacttttccaatttctcaatcatttcctgctgttgctgaagcatacgctcataaagctccaccattttatcaagaggattgaaagtaaaattaggataatagttataaccatttgattggtcattgaaagtattcgaaataatattcacggcttgttcctcatcaaaattctcaatcgcttctgcgggaactttcaaaatctttgcaacttgtgccagaatatcagattctacggtttctttttgttccagaagggagattttcttttggttccagtcgtcgcccagctcaaaagccagagcttcctgtttgatgcccagcatttcgcggaaacgctttatatttctaccctgatgtatttttttattttgcatatctgtgtaagtcataataacaaatataaagctttagaacaaaaaaataatgctctgttttaaaataaatactattctaaaatatccttctttctgaataaaatatcctttatccggatggtttatccttcttattatcccttcatttgttgaaaaataacaaagatgaaaagaaaaagaagaatgaacagcagcaaatataatgaactgcacaaccgtaaccttacggttttcctcaaatcgttttcacgagcgtatggcagaattgtatattttcctgaaataagaattacagggaagtgggtacagcaatgtggttttcaggcaggagataagatactggtaaccgtaagcagaaaccagattattttagaaagggagatgaattatgaagaagagtgtttttccaaccattaaggaggcttaactttttaagaaagttaagcttgtcacaaatcgaagatttaacatagtcaatgacaatggtgtaaattgtatatagttgtacttttactattcttaatggtttaaaattcattttgctttttggcgcaaaggttttgaaaaggcgaatgctttattttagggagcaaagagtgggcaagtggacttgcctgatgaagcggagtgaacaatttcggccaccaaaagcggccgaaacacacaagattaagttcttcttttatatttaattggaagtttttgttttctgtttacaaaaatgtctgtccaaaaaaatatgaagcacggtcataaaaatggaaatacttttctgctttttcattagggtaggaattttctcttttttttaacacactaaagagtgtgttgtttgatgattgcaaatgtataaaataattgtataaacaaaaaggtaaattgataaaattattctcataaagtttaataatctaatgttggtaatgcattacatgattttgcaaggatataagcggaaaaggcgtactcaggaaattgccttatctttggggaaccgatgtttctcagaattaatcaatatatcatagatgaaatttttactggactttttatttcgtgttttacagctttttacggaaccttatttcttgctgtttcttgtgatcgtgctcattgctctgttgaaaagaaacagtaaacataaaaaactgagaattggaatgggcatatttgccgttttgctgatcatctttgtaggaaatggttttctcggcaaactgatttcaggctatctgcagaaaagttacctcaatacttccgaaatcaggaattccggttctcaacatcccgtaattgttgtattaggtggcggagtggtagacatagaccatacagaaaagctgcatacaatgtcttattccagaatggtaactgcttaccagctttatcatgcatacaaaacaaataatcaatcctgtaaaatattagtttcgggaaaaggaaagggacgcatgagtgaagcggaattatttcgtgagaattttaaaaaaatgggagtggcagatgctgatattattaaggaagataaaagcatgaatacgtatgaaaatgcaaaatattccagcaggattttgaagcagatggctccttccagtatagacctggtgacttctggttttcatatgaaaagatctgttgctttgtttcagacctttggattacatcctgttcccaatgcatcagattttattactactgaaattacactgatttctaacagctacaatgctgcgttcacttttgtcatgcttaaagaagtccttggaatatggcaggtgaaggtgtataacagtttgggattgaatggataaaaaccaaaaactataaaaaccggacacttaagttattttaagtgtccggttttggtttaacaaagcttgattattattttgttttcttaatagaaattaccgtctgcaaaaccacagaagcaataataaacagcaatcctatataaaacgaaagatttacttctttgctttctccaaaaaataaaaatgccataataatagcatacacaggctccagattgtacgttaaattaaccgtaaaagcaggaattttttttaaaacctctgcaaacatcacatataagccaactgtgcaaaaaagtgataaaacgcccaaataagctgtattttttaagtcaggaactatgctatctgacttgaaatagaggagatatacgggcaaaagcgctccccagcatacagtaccggcaatcatctgataatagttgattaccctggtatcaaaatgattcaccaaccgtttgttataaatagtatacaaagcaccgaatgctgacgaaaagacacctaatataatcccaagctgataggaagtatcaaaatgaaatattaaactgattcctataatcgtcaacgtactgagaagtaattctgaaagcttgaatttttccttttcaatgacaggtgtaaaaactgctgtgaaaaaactggtcaggcagtaacataccacgccaatggatatattggcatattttatactcgcataaaaaagaagccagtgaaatgtaagcagtaaaccggtttttgaaatctgaattttcccacggaaagaaatatgaccggggattttcagcagctttataataaagaacaaaataatagaggagaataggagtctgtaccagaccagcaaaccttcgttaagtgtgatcaatttcccgaatacgcctgtaaacccggccagtattacggccagatgtaataataaatatgattttttcattagagaatgaactgtaaaattggaattaatatttttttagaatgtgaagcactacaaaccctatcgttaataaattaacgacatgagtacgcttcaaattaaattgaaaatattaaggtgccggaggaggcagacagttcgagcggttcatattttgatctgttgaaggccaaatataggaaaaattattttgaatctctacataaaaaatacgttgaacttgtgtccgtcaggatccgcaaatacaaagccataataattgtctccaaaactttcaggttctgaaacaatggttccacctgcgttttttacttcattggcccagttgtttacctgttctttagtttctgcagaagggtgaatatgatttcattggcgctttgcggatctccaaagttcatggtttttaaatttctttcgatgatatcttttaagaaaaagtggatgacaaattcattttccccgaaaaaaaagctgaccagttcattagagctgtgcggattattaggcttgaatcccagttctgtataaaatttctgtgtgcgttctaggttggttacggccagattggcccagatcattttaggtttcataggattgagatttaggttaggataaaggtattgtgtttaattttcataaaaactgtcatgtggcaagattttgtatttttaagggtaaaatgaaaaattatggaaaatattgctgtggagaaaggaaatggttatcctttaaatttctcattataacaatttaacataatatataatgaaaaaataatgaataaaaatatcatacataaaatcaatgcattaggaggaaatacagacgctgttaatgtttctgaaaattttgctgaaaactggaagaatataaggttcaacaatcatctttattacaaagactggcagttgtacgggattgatgagtttcatgaaacctataaagaactttatggccgggataagcagaaatggatatcctgatcatttttttgtatgtactacatatcctgatcagtcgaatccaacagtttacagcacagaccatgaagtatatttcgaggaaattgaaaacagaggaaaactggaggatttcctggacggattcatgacgaaagaagagttctcagaaaccgttataacatatctggaagaaaaaagtaaagaataagggattctcagacgattaatactctatttcagcagtattataaaaatcctataatttatattatgttaaattgtatattatttgagttcaaagattcaaagcacgtcccaagattttcattattttgaattctttattcaagtaacaatcaactctattcctggtttccctgcttcattataatctcatcataatatttttaaaatggcggattaagacttaatgtaaatattcttaatccgccattttgcaaattgatttaattcttcttatttagtttttctatttctggtaattcacttttatatttttcaacatcccaaactaaatcccaattttttatataatcagagattgggcctaggccaacttctgttcttcttttatctacattatcaggatctagtaaaggtaaaacatagtaagtattattactttgattgattcctatctggcttccgtatatttgttttctgccttcccggatttctattctatcaattaacaacgctaaagaaccggcacttgcatttccttttgttacagcatctttcatcattggcagatattttttctgcgtttcaagatctgaatgttgaatgacaagaaataaagcactgttggcttgtgcgcctactttgtctttaccaacccagcctttctcatctaatattttttttacttttattaagttaagtgagtctttctgcattgttattttccaaagatcattcatttctttagattgcggaccaaattttttctgggtttcatccatttgcattctgtatttttggtcttcctcgagaattgccaataattcagcctgcaggggtttgtcataattggcttctattgccgctatctttttttctaacttttcaattgttttcccccactctttttttgaatgtagattatccaaatctgtatcagattttaagtgctttagattggtccagcctttatctattgacaggttcagccatttaaaggcttttttcgtatttcctgctaaagcagatgagcaagcgccgttatataagtggcttggattttcgctttcaattttaaaagctttatcatatacatcagcagacattttataatcttttgctctgtataattgatcggcttcatttattaattttgaatattcctgagcattaacgcctgtgaataaaaacaataataataaagcataaatagtgtttctcatgttttctgtatttaattcttaaatttagatggttatgtttttgtttccaaatttacacattaggtaggtttaattgatatgacttagctccattatttgaaattatttaaatttatatatagattacctgttaaacggatattcattaacccaatgaaaccctcttttatttaacggataatcttcctttttctttcttatcgtttttattttcacagaatcactacccttatttccggtaaaaataatactatctttttgaagactgtaatgcaggtaagcatatatgttctgttcatctgctttacgaagcataagtgttttttttccggtatctaaaacactctgaaacgctttagtactgtcattattaagaattatgtttgtccttcccgggtaactgattattatttttttccagcccagtgaatcattgcaaggtatttcctggttattgataatatattgatcaacaatgtatgctccctccattgggacagccggcggtgtatagaacagggctgatgaagaactcgatataaaaaaagccactacaagccatttgaacgcagtaagagtaattctcttccattttttgtcggatgttcttttttgaaaacgtaattgcgatggctgatgcaatacaaaaaaacgatataaagcaatagtatcaccacttataataaagagacaaaataaaacaatatgactggaaaatatttttaccggtacatcataaaagaaattcaacagtgctacattgatcatcaccgtcatggaaaaaagtgctccaaaagttttggttctcctgaaaagaagcaaaagcccgccaataacttccagcaatccggaaacaaatgtataaccagtggaagctcccatcatagtccataccacacccattggcgacatatctccaactctttcttccagtctgccaatggtgttggcgggaaactgcccgtcgtgaagtttggcaaaaccgtatgaaagcatgatcatagcaacataatagcgtgcgactaccaccgtaaaccaatgcaagtctttaaatgtccgctgttttttatctgcaagaattataacgagtgcagttactacagccaagacaatatttacagccactacccaataatcaagcgtggtatctccactacccgttatctcaatatattctacctgcttttgctgaaaaacatttttacacaaccacaaaacgctactcttatagactcccccaaaaggtgaaaactgtgaggtaaaaataaaaaggtacacataagaaatagcacacaaatgcaggaaacgtactacagcattgcggtttctttggttggaaaaattgatagattttgtatccatattaactatttattacttaatcttaatgataattgttttgtgatgttatttgtactaaggtctggattcactaatgatttttaactgattcctatcatttattatctacatcaaaaagtttctttctaaattcaaaaattaacttgtaattttcttcaattggaacttccttttttgatactgtattgatgtttttaccttgttccgtccataagtaaggataaaagctgaatacctggtcgcctttaagttttgctacatctttttcccagtttagccatctgtatccattataaaattcatcaagatttttattaaagcaaaaattcagaaattcagtgtaagtaaggtcgagtggctcaagttccaaattatcaggagccaaataataaacttttcctaaatcgctgccaagtccgccaccattaagaataaaaatgcctcctattgcatcatcggcaattaaaagatatggtattggctttccataattctcaaatgtttttcctctattccattccggcaatgacctgtttaacttatcacttcctgaaccaagaattcttatccagccattatcaaccaaaagtccccctgtcatgtatacaattgaacccattggagatttggttgtaacttgggttttatataaagcatcctttgctttgttgctatctacaggcaatatttccactttattttttgcggtgtctatccattcttttacaagaatccaaccttgatctttatcgtttattaattcatcaatagagcgcattttttgtccataagttgttaatgagaataaggatataataattgtcaaacattttatcatgctgtttagttttctaagatgataattaattgtatacatttttctgtcattattttacctcaattttatgataaacaatccaacgtttgagattgtccaccattctttttaaatgatcctcattcaggaaaatattggtccaagcaagcagtgaagaggttgctgaagtgaaaactaaaagaaagagtaagtacttttttatcatggatatcagttaagactcaaatttacggattgtgttcttataaaatttgtaacgatggcaatgttttttgattttttccataaaaagctccaaaatccttagattttggagctgaatttaaaccgacagcctttcagctgattaattattgcttggtaattttattgaaaaaagtatcacctttaaagatatagtctcctgaaggatattcagtcagatcgatggtatttttcccttttctaaacaatatatttttaatcaggttaccgttattatcatataaataaacattttcatctgctgaggattccacattgatcactcctgtcgttggattaggataagcggaagttttcgtttttggagaagcttctcttgttgacagaaaacaaccggaaatataggaatctccaataatattaaaacctttgttgatcagctgggctctggccagcatcgcttgcggtgtagaataaaccagtcctgttgcatctatagttccggacgttattgtggagttcgcccaggtaggattattattcagagcgatgagaaaattgctgtaattcgtacatgataagcctgcatttttaaatccaaaatagattgaattccagctgaagttctgaagcttgatattccacgcagaaatatcctggtcaaaatgcgaagcacctgcaaacatattaaatccggcgaaataatcagccttgcttacatcccagtttccgatgggttgattgaatgacactgcattttcaaacatatgctcaaaatctgttactttacctgtattccagttatcaagtggctgattaaatgctgccgcattatagaatgtatagcggaaattggtagcattttctgtattccatgaatttaatggctggttgaaagctgtggcatctgcaaacatggatgaaaaatcagttccggatgttgtgttccacgctgaaatatcctgattaaaagaagaggcagaagaaaacatgctgctaaaattggttacttttgatgtatcccagtttccgatgttctgattaaaccgcgttgctccgctgaacataccgctcatgtctgtaatacggaatggattccagtaagaaaatgaagtatggcctgtcaaagatgaacagttaaggaacatttgcgataaactggtgatctgtgttaaatcaggagtatctgcagccgttacgttaagattaggacagttggcgaatgctctgtcgaattgctgaagccatgtcgtatttccccactggctgagttctatgagttcctgatttccacccggaggaatgatgtcggtattggccctgaacccgtaaaatgatccgttaccgctgaatacttttaattcgtaagtggcctgcagaggatctggatggaatgatggcccaaaatatatgagtaaaggctcactgctgctagagtttacattatcaaacatcccgttatgctcaggatatcctacttcgtgccagtaaatggtgtaatcggttcctgtgccaccgaatcttattgaatgatcaatgatgccgtttgcattgggtttccagatggtagtgaattcattctgcgcataggaaatgcaaaataaaaggagaaaaatgattattagttgttttttacacataattttaaaagttgttttaaggttaaaattgggttgggtaagacaattaatttcccgggattctttatcttatctctgatacaaaagtactggtgcacagcgacaaaactcgtcgtgttataatttaatgacttgtttttttacgtttttttgaggtaaaaaacctctgaagaataacccggaaatggtaatgacaaaatttgtattgtaatgttgattttgataagaaaagatgccatagaaacattggcaaatgcagactaatgaaggaaaaatgaacgctttattcagcagcatttttacagattacagcaaaatagacttggttacaactcttcatagctgccatgttgataataagttgctgaaatatttggaataaagaaataaataggaataaatattcttaaaagaaatgattatggactaagggcataaaaaaaccgctctgaaaagagcggtaaatttttaatgtcaaattgtttgctgattagcaagtagaaccgcactcaagtaatttgatgtggattacaccgttaacaacacattgtgtctggcataaagcgtttgttacaacagtgcttacaccgcctactactccacctactgtagatcctacgccagttacaacaccaccaacgatagtacctacaccgcctactactccaccaactacacctcctagtccacctagaagtccgccgattggatctagtaatccgttacctgaaatagcttttaattcgtttctgtccaatttttttaagtttttcataactatatttttatatgattattacatcacgaatatatgaataatatttacacaattgcaaattattttaaataaattaattatttgttcttattgtttaatatttcattaatatataggtgttttaataaaaatatgattttcactgatatgtgattgattttctaaatgttaaaaaacataactcaatttatgaaatttggagttattatttatgtattaaaatatatttattgttgtttattttttaatttatatagaatcattaaaattcttcttaaataaggcttgaatggatagaaaatgagtctttaaaatgctgcaattcatccatttcggagaggaatagcgaaataatcaataaaatttgcttcctgcaggcagtaaaacccatatgaattactgataacggaatcaaattttgtatttttgctgacatacttttatcaatgtcagttttttcaaataatatacgctttttaagagccagaagaaagctctcccaacagaatgtagccgatgaactcatgatttcaagagtacggtattcaaaatatgaaaacggtatatctgaacctcctattgagctgctcgtaaaaatctcaaaatattttcatgtgagcattgatcttatactttctgtagatctggagaaacatccggtggatgaaatgctgaaacttccggataacaggattgttcttccggtagcagtggatactcaaggaaatgataccatagaaattattcctcagaaagcttccatgggatatctggaaggatacagcgatatagaatacattgaaagtcttcagcgtattgcgcttccttttcttaacaacggaaaatacagggcctttcctgcagatggtgattctatgccgccgttcaggagcggttcttatatagtaggaaaatatgtagaaggcattaatgaactgaaagaaggcaaaacctatgtttttgttacactgaatgacggtattacgtacaagcgttttaaagaaaggaaagaaaatgcaatctgtgtaagtgctgacaattcattttatgaaccttatgatattccttttgaggaagtggtggaaatctggcagtatgcgtcaggaattttccctgaagattttgaaccgggtgattatgaaaactataatttcaaagagatgttccgggaactgagaaaagatatcaaagatcttgataaaaagatctcgggccgacgtcgtaaacagtcataaaatcaatatctataataaaaatgctcctgatgttaaatcaggagcatttttatatatgtttatgctataggtcctcagaaagttcaatccatacgggagcatggtcgctgcttttctcccagccccgcacgtggcggtctactccaccactttgtaaccgggaatgaaggtaagggcttaataagatatgatccagtcttatccctgcatttctgtcataagctttgtataagtaatcccagaacgtatagattttctcgcccggatagaggcttcgtatagaatccagccagccttttttctgaagatccttatatacttttcttacctctgcccggtataatgcatcattttcccagcgctcaggtttatggacgtcaataggttccggaatgatattaaaatcgcctataagaatggcaggaagttccattttaatgagctgatcggttcgttttttaaaacgtttgagccatgataatttataatcaaacttaggccctggataaggatttccgttgggaaggtaaaggcagcatatcaccatctgatctataatagcttctatataacggctttgaatatcgtctggatcacctggtaaggatctttgtacttctgtgatttctttgtttttcgttaatatggccaccccgttccagctcttctgtccattccagatggcctgatatccggcgttattgatttcctgcaaagggaaacgttcctgaggtgcttttaattcctgaagacagacaatatccggtgaagcttctttcaaccacttcaataaaacaggcagacggccgttgactccatttacattataggttgctattttcatgatgaaggtttttggaaaatcaattcttttttaattacgacaataattattccatcataaatatctcttggttggtattttgtgaaataataatctgaaaaaattaagttttgatgaataatctctgggctgtgaggtaaaagttcaatatatttgtgatacaagatatagctcattaatacttaaatccctcaatgaaaagatatacgacctttttattagcattactttttcctgttacgatgtatggacagcagaatctcactgctgacgaattgtttgctaaagcccgtaccacggcttttgaacagaaggattatacaacttctatagcgcttgctaaagaagcattggaaaaagcgccgaattatacagatatttcagtttttcttgggagattatatacatggaataaagatcttcccgcggcgagagctgtatttgaagaccttggaaaaagaggtgttcaggatgaagattattttctggcctacgcctcattggaatactggaatgatcagaatacaaaggctatcgaaattattgataaaggtctttcctaccatccaaaatccgaagcacttttgctgctgaaggcgaaagtgtattttgggatggatcattatgaggaagctgatcaggctgtaaagactcttttatccattaatcctaaaaatacggaagcaagagctcttgctgtgagaataaatgatctttcttctaaaaatgcggttggaattgtttacaactattcccattttgataagcagtttgatgacgactggcatattgtgggagtaagctataagagagtaactcctattggttctgtgattcttcgcgggaactatgcgaataaatttgcgcagggaggaacgcagattgagctggaagcgtatccaagactttcgaaaatgttttatctgtatgttggcggaggatattctgacgatgtcggtctttttccgaaataccgtacaggagtttctttaaatgccaatcttccccacagcttcgaggcagaattaggttaccgtcaattgtatttcagcaacagcatctggatgtatactgcggctgtaggaaaatattataaaaacttctggttcaacctgcgtacttatattacgccggacagcaaaaatatttcacactcttatacggctacggtacgatattatacaaaaagtgcccaggactattttgcttttcagataggaacaggaatcagccctgaagaaaatcgtaataacctcctggaaaacgaaacttttaagctgaaaacgtttaaaataggtgcagaatataatttctcttaccgcaccaatctgttttcagtaggtaccatgtattataatcaggaattccgtccgggtgagaaaggaaatcagtttgatattactttaggttacaccagaaagttctaaaactttgatttcgtttttttcttaaaattaaccattaccgaatcaggcatcagttttttagtggaataaaactttgcattcatacttttatactgattgaatctgccattgatcttattcatggctgccgcgtcatcggaaggatcttcttccaggttcttaagcgtgaaaagctgtccgtcatggatataatacttttcagatacgaaatcaataagctggtttttactctgcatcattggaattcctgccttgctgatttcagcatctgcagaaaagcctcttcctacccatgttacggtagaaggtgttttgatctgataattatttctgtaataggccagaatagaaggtgcaatatcaaaatggcttactgttttataaaaacgttttgattcctttaataagggtgaatagatcaataatggtacatgaaatctgtcaattttagattgtaaagtaatttcaggcatactgtgatcccctgtaatgacaaaaattgtattgttataatccgggcgtttgctgtaatttttaaagaaacctttaatcgcatcatcggcgttcaatactgaaatgagctgatctttatgagctgttgcccactttttctgttccgaagttaaaatcgcggaattaagcctttgattatacaacttttcataataatctttattgttaattaaaaaaggattatgagttgaaagcgtaaggatcatattgaaatacggctgattctgtggtttttgctgctcctgcattttactaaaaacggcctggtcttcatatccccagctctctccgttgctggcaggaagtttacggtacggactgctgaataatgcttcatctacaatgtggtctacgccactgtattccagaaactcacgataccggtcaaatgatgtatgacctccataatagaaccccgtttcaaatccgttcgctttaagaacattataaagattgaaattctccggtgttttctctatttcaagaaacccgtttttcccgaaaggaagtgaacctgttaaagacggtaacgctccgaatgttcttcctgctgaacttaaactgttctcccagtacaagcttttattagaaagagaatcaaggtaaggagtaaaattaccgatgtatcctttgggtgatgtatacgcgtgtccgaagccttccatgataaggaaaacaagattgggaaccttctcggatctgttaaaatatgatcccaggaaatcgggtgtattttcttttctccagaatggaaaatttttatcaagcatttccgcattggcggtatagtcttcattttcgcttagcaattcggtcagctcaggatgattactgatgaaattatcttcgttggatttaaagaaataagcccatttactttttgctgcattttgattaaactcactttcagagctcagaattgtggatcctacgatatcggaaggaataaaaaaggcagctaatcccaataccatgattatcaatcccggatacattgtttttaaagcggttttacccgcaatccataaaggaataaatgagccggctattaaaattcccagtagtgcaaagtttttaaaattgagcattccgctggcctgtaagatttgctttatttcttctttactgtaatataaaacatctgcccccaatacgtttcgggtttcagaaaaatacaggaataagatatattgggtaacagctacaatgagcagggttactacccccagaatccttgcccagccttctttgataaaattgatgatcagataaacaaatccgatacagaagattagtctaagagcaaataagatattttctgtgaaaagatggccaatgatagccggagtttcaaattttggaaagatatacttataccacaatgattctgcaactacgccaaccaaaaataaggcaaagaaaatcaatgccagcattccccactttttaagtcccacctgaagaatagcatatattctttctttcagaggtaaattttgtgtactttgattaaagccttgtctggtcatttcaccccacccatgcgattttttgaaataatctataaacccgtttacccctgctttcaccacaataggatggaaataaaaaggttcggaaaaggcggtgaaaatcaatctgaggaaatctttccttttggtataaacctgatggcttacaagatctaccaatatggcatagatagaatacaggaagcccatcgagatcacaagagcaaacagaattacaaaaaacggccagttgataattcccagcaataaaaaaatgataaagatgatgtatcctgaaaactcgataagcggccccaaaaattcaaagaaaaaccaatacggcagactgatcattcctaattttctgtatttcggattgaacatcagtttcctgtgtttccacagggtttccatcgttccgcgcatccatctgtttcgttgttttctgagaatatctttggactcgggaacctccgtccagcataaaggatccggaatggtaagcacttcataaggttcgttcctttcttccatgtatttcctcattcttaccaccagctccatatcctctcccactgtacttttatcataacctccgcatgccagcacaatttttctgtcaaaaacgccaaaagcgccggagatcagaatcagaccggatgcacgggaccacgccatacgaccgagtacgaaagcccggatgtattccagagcctgtgttcttcccagcagggtcttcggcatgttgacacttactacttttccgttttcaatgacacaattgttggccagacgaatcactccaccgcaggcgatgaactttttatcggtctgctccagcatcggttttgccagttttaaaatcgaatcctgctccagaatacaatctacatcaatgcagaccagatattcccctgaagagatattgactcccacgtttaaagcatctgcttttccgccgttttccttatcaacaacaataagctttttaaaggccggatttttacttttataaactcctcttactgcattggtttcgattttcccctggatgaaataagccacagattccagttcataagcttcgatcagtttttgtatggaatcatccttacttccgtcgtttacaataataatttccagattatgatagtaaagggacagcagggagcgtacattttccacaatggtcatgccttcgttataggccggtgcaataacactgaataccggcgcattgggattggccgcaatgatactgtaatctgtaaatgtattttcttttttataacgcagtacagcgcccagtgcatatattcctatccacccatagataagggttactgctgttccgtaaattaaaaacagccagataacaacttcatagatgatgtgtgagaattctaacatactttttcctgtaatgcgtatttaatgatttgaattaattcttctgttgtttccctgttcaatacttctgtcagatactcctgctgtcgaagtgcacataaggcttctgcggcatacactttcacgcctgaatcagtgccgttcattaactggtctttcagaaaatccttactgcgctggtcttttgactttttcatgactttaaggatctctttctgaacttcagccggctgatgcggatagacttccataagatgggtaatcgtagaagagttttccagtgataataaagtttgtaccgcctgtatccgtacttcagaagaagaatggtccagcagattaataacagaagaataaagggatagtatctgaaatttccttaagagtttaagggtgaaaataactacggaatcattagagctttccatccagcttttaatatgatctccagagttgtcaggaatctgatttattgaaagaagcaaacgaagctgctgccattctgatatggtggaggtaatgctgctcaggaaatgaagtccttcaaatcctttaaagtgaaccattgcatattgtgcttcctgatacacctgagcagaaggatgacttaaaaatgtagatatttttggtaatgcttctgctacattcatggcggtaagttcctgtattccccctgcaattaagtgcacttttttttgactgagtttcttaaatgcttcttcctgaagcccatattcacggaataagtctttcagtttgttttgtgctgctccggaaaatttcttctcggattctgccagcttctgtagaaataaatttctgaataaggaactgcctgatgctgatgagaaattatcatccggagacatttcatcttcaccatatacaatcacttctgaaattctcttattgattacttctgaccatctggaagcctgcacggattctctgtactgataaaaactgtagatcagcactacaataatcagcaagagaaccagggaaagcatccccagaaaaacaagaaaaagaaaatgtatagaagtggtgagaaacatggttatggtttatcttgaagaaaatctttttattcttaatatcaattcattggggctgaatggttttacaataaaatccgctgctccgaggtcaaaagcattcagtaccacctcttcctggcccatgctggaaagcatgatcaccgggatctgtttgcccatggttttaatggcggaaagtatttcaattccggaggcaaacggcatcatgatatctgtgatggccaggtctacatcttttgttttgagtgtttcaatagcgtcttttccgttacgggtaagaatcacttcgtgcccctcttttaataatttgtgctcaatcgtttttagaatcagttcgtcgtcttcggcgatgagaatcagcataattttatttatttttattgtattaaatttttaatagcttgtaatcctgttgtaatatcccggataatttctttttccatggcgataaaatccatgtcggtttctgattttttttcccagtccgctgcatgttctgtgagtcgtatcaatcctgccgttcctgccgttcctttaagcttatgaaggatcattttcagggctgcggtgtctttttctgcagcgctttttctgatgttttcttcggcctgagtaagttcctgtaccacaaggttcaaaaatatttgtttggaatcgtcatcatcatcacccatatgttcattcaaaagctttatatcaaagaatttttctttatctgatgattcttctgcgggaatgtgattttcattaaaaatatatttttccagtattcccagcagatctgcctgtcttaaaggtttaggaaggaagtcattcattcctgaatccaggcacttttctttttctcccagtacatttcctgcagttacaccaataataggaacaccggcataatccggaagtaaccggatttgtttcgttgcttcaataccgtccattaccggcatctgaacatccattaaaataatatcgaatgttttttctttgcactgctccaaggcctgaagaccatcagtagcttctgtgagctgtgcatcagggattaatgaacgtaccattttattgttcagcaccatattgacagggttgtcatctacaagtaaaaccttggcagactgcatgagctttggtgcattagtttctgcttgtgtgttactgtttatctctttctcagtattttttacagcaagcttcagcgtcttgtaaagttcttcagatttgatcggtttcaataagaagaatgaattgttttcctggcggaaagaattgataacatcatgctcttcagaagaggtatgaaggataatgagaggtgatgattcattttgtttatcaaacagctccctgattttttctatggtttccagtcccgaaatgaccggcatgtgataatccatcagaatcacatcaaaacgttctcccgcaagcagtatctgaagggcttccattccattggcggcaagctttgaatctacatttttataagcgagcatatgctgaatgataatcctgttggcctcattgtcatctacaatcaatactttttttattttcagatcttcctcttcatggcgctcagacatttcgtaagggacctggatatcaaaatagaaagtagacccttgatgaagctcactcaccaatgacaggctgcttcccatatagttcaggatattgttggaaatggtcagtccgaggccggttcctccatactttttgctgatagagctgttttcctgagtaaaagcattgaaaatatgcttttgtttttctttaggaataccaattccggtgtcccttacggaaaatctaagggtaatatttttactctcaatacttagtttttccactttaagttctatttctccctcttgggtaaacttcacggcatttccaagaagattgatcagaatttgcttaagtctcgattcatccagccagatggtttcgggaagtcccggttctatatttaagagtaattctatattctttttctgggactggtaaaggatcacgttgattacctgactgacaatatcataaacattggctttttcaatggaaagctccatcttcccggattctattttggaaaaatcaaggatatcattgatgatactcaacaggttttcaccagattcattaatataattaagatactgtgtctgtatttcattcaatggtgtttttaagagaagatccgaaaaaccgataacaccatttaacggagttctgatttcatgactcatattggccagaaattctgacttcgcctggctggcaatatcggccattttctttgcattcttaagttccttattgattttcacagaggttgtaatattctgtgcagcaacaataattccccctataacattactggaaaggtaccatggggtaacctctacattataatgctgaatagattccttgccgggaatttctatcgccatatcttcattcttgtaggcttttcctgccagtgcatcccggtatatttttattctttcatccggtacatccggggaaatcttaaacatgttctctccaatgagcctgatgtcgttcatctggaattcatctttccagcttctgcttactgacagataattaagatccttatcaaacatggctaccgtagccggaacataggcaacaaatgactgaagcatagcctcttttctggccagttcgaggtaaacttttttgaaattatcaatatcctgtataattccgtagactctcgtacatacttcgccttcaaattccggtattccttttacccttacccagatcatgacgccgtcatttcgtaccagctgtaattcttcatcgtaaggtataccttctttcactgctctctcgaataaggattccagtttttcccggctgttttcactatagaagcctaatgcattctctaaatccggctggaaagttttatctattttatgtatttctctggtagactgtgaccagattacagtattgtttttgaggttgacttcccagcccccgacctgggcaaccgcactggtctgttccagcattttttttgtattgaccagatctttttccagtgttactctttcggtaacattcagtgcggtactgactacgtaaggttttccttctttattgatttccacaaggttgtggtacatccatattacttcatcacctccttttgttttcagaatcatggttccgaaatcttcacggtttttgttgatacgctccagatattgctcaagaagatgccagtttttttcagggacaagatcttttaaattcaggtcttctacctcttcagcagaatattgaagggtttctcttcctttttcattgacggcgataatatttccttccatatcatgcatactcatcagtcctattgcattttcgaagaagcttctgaaacggcgttcggagctttccagttttagtttttcttcaatacgctgggtaatattgattccgaagcaaaaaatatccgaatggctttggttcagttttaaataccattcaacaataatggtttggttatcattgatattggtagaagtggtaaacgttatctcttcatccgtatcaggaagatctttagaaagtaattgaagctgggaattatggctgcctaccagatcaaggaaattctgattgataacctggcttttatttacttgaaatgcattttcaaaagccgggttaatatctttcagtaaaaaatttttgtccagcacacagatcaggttattagaaatactgaaggtctgctggaaatattctgcctggatatttttccgttttcccatcagaagtttcgtgaccgcttcccctattttttttagggtagagatctggtcttccgtaatagttttaggcttataatcaattacgcaaagcgttcccaatgcaaatccttcgtcatctaacaggggcactcctgcataaaaccggattccgcctgccagtatgagtggattatcagaagatctttcatccagtaaagtgtcattgatgactacaatgtccccactcgcgatagaatactggcatacagtatctttcctgtctacaaagtccagggcaagtcccacacaactctggatcgtctgggtttcgctttccatcatggcaataagtgctgccgggcagccagtcaccagacatgctgtttctgcaaaaacgtctaactggggatctttttccaggtttaaaagatcaaaaaactccagttttctcattcgatcttcttcattcgcaggaattgggtacttcttcatatgttatttcaacggttagagatttttcttttttgattattaaaaaatgataatcaagtccttaaagtttatattttcaacatttttaagtgctttaaattattattttaataagtaaagcaaaatacgaaataattttgtattccgttgcagtaaatttgttaataaaggaatatgcatggttattttaaaatattttaaagatataaagaagtaataaacaatataaaataaaaagtaccacatgtgatcatatggtacttagtgtttgaatcaggatgaaaagtaatgttttaacagtgtttttttaaggcctgacgattgatttttaaagtccatttccggatgagcccggaaatggacacaccacttatcatcatccaaatcacaactatactatgaacagggaggcaatagcctgcgcatcgctgccacttaaaatctcatcataagctgcagaaccggctgcagctccaaataaggttcctgtattgaaacccgcctgattggtattatcttctcctgcataaacaggattggttgcagaaggcatacttccaccatcggcaagctctatccatcctttgtttgctcgcattcttcttacctgcgaagcatgtctggcttctacagaatgaatctgtaaggctgcctgaagcacaactttattggacattacgtttcctgcctgtcctttgtatgcccttactcccgtatcttcaaaggcctgggcaagaataagaaactgattataatctgtaaaaggagtaaaatttccaccagcggtaaaatcaaaagtcggtttgtttcccggagttgttcctaaagaagtcagtgtgcttttcagaaaaccaacatgagcagattcatgctttgagatctgcataaaaactgttctgtctgcattcggaataagtcccggtgtggacaatcctatgctgtaatattcattttcaaggtattccagtaccaatgccagctgcaatgcatctgtgagggtactttttaaagccatacctgtgaatgctgtttttgaggtttctgctttagccggtgttgccatcagtgcacccaatccaagcggaactgctgctactgctgctttttttccggatagagacatattggtaatcgcctcaagtcttgacgcttccgttgtgaagaatttatcatgggaaagcttatccagtaatctaagaatattcataatgtgagtttttaaggtgaatgattagttgatacctctttctttccaggtaaaaggtgttttgatgaatgctccggcagccattacgatatctttgggctcttttgcgaggtcaagtccattggcatctatcacgtcatctcctgaaaaatctgcagagccgggattgatgatatttctgatggcggaagcatgtctggcttctactgaaactattttaccggcaataacaaggtaggctgggttggaaatatatttccccgcaccattgtaagcggctacccctgtatcttccaatgcttttgcagtggccagaactgagctcctgttattaaaattcacattcgggtactggaattcgagcttaggcagcacatgatctgtagctccgctgatggcagctttaaagaaatccctgtgtatcacttcatgatggtacaggtctgtaaaaagttctttttcaatacttgaaattcccgtatagaaattgttgactactttcgtataaaagtcagcttcaagctgttcaagggcgtaggcgtaatttaatactcctacatctcctgttccaaggtcatacttggattcttcaataatctggaagtcgtcattgtcgtcacagccaatgatggtaagccctgcgatggccagtcctactccacttaatttcagaaagtttcttctgctggtatcaagggtagctccctgattagaaacgttaatggttcttttcatactattaattttttagtgttgtatttaagagaaaaaaacagcatatcagtatgctgttgaaatctcacaatttgttatggcattaaaactgtatcgatgacatgaatcacaccattagactggttgacgtctgcaatggttactttcgcgctgtttcctttggcatcttttatataaaggtcttttcctttagtccagaaagtaagttcctctccctgtacagttttcatcatactttttccgtttcctgcttttacggctgcccagatttctttagcactgtatcttccgggaagaacatggtacgttaagatgctggtaagtgttgccttattttcaggttttacaagattttctacggttcctttcggaagttttgcgaaagctgcatcagtaggtgccaatactgtaaaaggtccagctccttctaatgtttccaccagtccggcggctttcactgctgcgaccagtgttttgtggtctttggaattgacagcgttctcaataatatttttggacggatacataggtgctcctcctaccattactgttttttctttcatcgtttgtgcagttacctttccactgaaagcaaatgataaagctaccattgctaagactgtgatttttgattgtgtgttcatcgtgttgatttttttatgaattatatttatttgtgcttttaatgtcatttacgaggttggttttattttagattgaaaaaaaatgaaatttattttatattactgattttcagttatttatttttttaatcgggacaaactccagacagatagagttcatacagaatcgttttccggttggttttgggccatcatcaaaaacatgtccaagatgagactcacatcttccacacagcacttctgtacgttccatatgatgagagctgtcttttctgtattttacactgtttttacgaagaggctgataaaatgagggccagccgcaggtagttgcaaatttggaagttgaaaggaagagaggattcccacatacggcacagtaataggttcctttttcatcgaattcataatattttccggtaaaagcagtttctgtggctccttctctggctacctcatagagttcggggtttaaaatctttttccattcactattgcttactttcagtgtattttctgcagtgtgtgagtaataaggatttctggttttgaaaagactgttttgggctgtgcaaaatccgaaggacaccgttacagaaagtagaagtattgtttttgaagataaggttttcatatttcaatatttttaatgattgtcttaaaatcatgtacgaaataaaagttgactcagatttttttgggaatatgttttattttattacatttgggtagaaaaataaaagctattaaaacaacctattctgaagaggaacttatcgttttattgaaagaaaaaaacgaaactggttttcattatctgtatgaccactattccggtgcgttgtacggggttgttcttcggattgttcagtctaaagaatatactgaagaagttattcaggatgtttttgttaaaatatggaactccattcatcagtacgatatttctaaaggaagattttatacctggatgattaatattgcaaggaatacggctattgactatctcaagtcaaaaggattccagaatgaacttaaaaaccaatcacttccggatttcgtatataatactgcagaactttcaacaacgaataactcttccgattatatcggatttaataatgtgctggaaggtctggaagtagacaagcaggaacttatagatcttgcgtattatcagggatatacccaacatgaaatatccgaaaaactgaagataccgctgggaacggtaaaaacgaaaatgcggaacgcactgatgaaattaaaggatttgctaaaagattaccaataaattgaacactaaagaatacatatcatccggaattatagaatcttatattcttggccatgcttctcccgaggaagcagggattttggagtgtgtgatgaagaataatgctgaagtaaaggcagcttttgaagaagcgcagaaaactttggaagatcttgctacggcacaggctgtaacccctccagatgatcttaagtctaagatctggaataaaattcaaaaggagcagactcttcaagagattactcctgttctttcaactgatatttctgaagtaaaagatcatacagagaacagaatccaggaatccagccagcgaaataacggatggaaaacgtatgcagtagcagcctctgttctgtttctggtaagtgttgccggtaacttttactggatgaatacccaatctgccagtcaaaaagagatggctctgctggcagcagataaaaagcatcaggatgaggccatgcagaaaatgaatcagaagcttgagatgttttccaatcctgatatgaagatggttatgctgaaaggagtagaaaagcatgcagatgccaaagcaatggttttctgggacaaaaaaacaaaagaagtttatctgaatgctgaaaagcttccaaaagctcctgagggtatgcagtatcagctttgggctattgaaaacgggaagccggtaagtgcaggaatgtacaccgaagataaagacagcagaatagctttagctaatattccagatgcccaggcctttgccattactcttgaaaaagaaggtgggagtaaagtgcctaccatggaaaatatgtttgtaatgggggaaatatagccctttttataataaaaaaacaaggcggacacaatcaaacccgccttgccatctcccaaataattaaatatgaaaaaatatgaatgttttgtttatacaggacatacgcaataattaaggttaattttaaatatcttttggaaagggatcttcaaagctttgctttttgtcaaacaattccttttctctttcattgataaggcaatgctgaagatcagacaacatttgatctttgtccagattctgcccaatgaagaccagttcattaatcctgtcaccccagtttttgtcccatcttttttcaataaaactttgattttccgcaaatgaagaatactgcactctacgacttagtggcatgctgcaccaccatacccctgctttttccaaacggaaagatcccccggcctgagaaaagttcagggcatcatcaggtcttgacgccagccagaacaaacctttcgctcttattgttccttcgggataatgatgattcaggtattcccataaccttaccggatgaaaaggctttctgtctctgaaaacgattgaacttattccatattcttccgtttcaggcgtgtggtgctccgattgcagttctttttgccagccggcagatgactgcgctttgtcgaaatcaaaaagccgtgtatttaaaatctgttgaggatcaatttttccaaattctgagtgtaagataaccgcatcggggtttaatttttttatagcagcttttaaaaagccaagcttatcagcatctataagatctgttttatttaaaataatcacattggcaaattcgatctgatcggtcaaaaggttaacaattgtccggtaatcgccttccatatctgtaagatcgcgatccatcagcaactcattagaaccgaaatcttttatgaaattaaaacaatctaccaccgttaccatggtatctacataactgaaacgggaaaggtcgattccgctttcttcatcaatgtaggtaaaggtttgggcaacaggaaccggttcactgattcctgtactttcaataagaagataatcaaaccggttttcgctggcaaggcgttccacttctatcatcagatcttcacgaagtgtgcagcagatgcatccgttgctcatttctaccagcttttcttctgttcttgaaagggtgttttgattttcaacaaggcgggcatcaatattcacttcactcatatcgttcactattacagctacttttaaacctcttttgttatgcagaatatggttcagtaatgtagtttttcctgcccctagaaaaccactgagtaccgttacaggaagtttctttgtcatttttaatgtttatgatttttaaagttgatgatatggcctgtaattaagcctgcagctcccacatagattaagggaagatgaacttcatacagaagatctgtcagtatagaaatgaaaataaggcttaatgatatccggaacagaaactttagccaccggctttccattttttttgttattctgaataccacaacggctccaatgaaaaggaaggccagatcaatataaggattatgggatattcccaatggaacaattaatagcagtggaaagacaatacaatgaatcaggcatagaacagcagcggagattcctacagcatcaagaatttttgatttcataatagtatagaattaattttcttattgtaactttgttgcaaaagtagaaataaaaaattaaatattgcaactttgttgcattaaaatatgaaacaggtcagaaatacgcatgccaagactgaaattttaaaccttatcaatggttcggatgtagcccttacgcattctgatattcagaagaaattaggtgatctgtgtaatagggtaaccatttacagagtgctggaaaggcttgaaaacgaaggagctatacacaagatcgttaatattgacggggtggtaaattttgcgaaatgcagcgggaaatgtacccatgaacagcattttcacaatcatgttcatttcaactgcaaagaatgtcattctgtgacatgtattgaaaatgcgattccggagatcagtctgccggaacattttattgcacaggagtacaattttattatcagcgggatatgtccgaagtgtgctgatgcttaaaagcgaaaggtaaaaaaacaaatttgcttgtatgtttttttacctttttgcgatttgttataaggaagagatatagacttctattttggttccgtcataattgaaggttccgtcagaattctttttgcctaatacccatttcatgtctacaggtacagaccatgcagatcctaatgaaaatccattaacggatctgatttcatttccttttcctgtagtaactgctgaatgaaaccagcttttatcaatcagtctgtagaaaccgattgcttttcctgccgggatcggtgaatatccgtcccacttctctcctgccggatagttgaaaacagttaaccatttttgtccggctgattctgccagttgagcaggacttatagatgcaccacgcatatataatgcatacgctacagcatcatggcatactccactgttgtatttcgaaatattttctgctcctgaaagaagagcaagcgcaacaggcgctctttcggatctggatagctgagccttcctggctccttccggtgtgataaatgacatataataatattttgtttggtagggtaaagatacagctttaaaatttaatcacttatgttggataatattttaagttttggctgaagccgttgatagggtcattaatcaataagcgggttaaaacccgcctctattgatacataaacctggtattatatctgagaatggtatgaatattcaataggaacgggctttagcctgttctaacaattgcatgcagatagttcggcttcagccgaaacttaatatcgtataggtttggctgaaacctttggaatggcagataataaaataatcgggctttagcccgattctattgataagtattaattaaggattcatttagcaaaaatacatgcattcatagctgaaaagctttccgtctttaaaggtaaaaataaaaagtcctgcatccccgttctggatatgatactcgtgcggagaggagacccagcgtgaagaaagcagatccccgaaatgcgttacaaaattcttttcatcataattggaatccatacgttcatttcctaaaaccaaagcttccccattggtaaaagacattttgtagacacttccggaaatttttcctttatattcttcaaaagcaacaatgatgtccggtgttttataaaagtattgaggctcccagccgcattccggcatatcagaaatatcatttactttctgcatttccagctttttcatctgggaatctgttattttgccgtcaaaaagcgttgtttctttccataagaaatgcatattcagggcttttactttcttttcataatcctttgttccaggttttttttcaaactgctcagccagaagaagctcaaagtcgatatctattttcggattttctatgccggtattggattctttccagtattgtaaggcctgtttaagatttttatcttccatccaggcaatttcacgtaaccttccaacctgcgtcaattctttttctttgttcttgcctttcaccgcaaggtagtctttcagcactttttcgtaggtaagttcagaaccaaggtacttcatctggatatattccggattttcatggaaatgatcaccaatataaacccagccatcctgatataaaggaacataatcaatacaaaccagctcatttaaagcagctctccgtaccggcgtactttctgttgtagggcctttccgtacccgaagttctgatacctgtatataaaaatgcggacattgctgtccctgcgacccgcggtagaaatactgggcaggttcacctgaagattttttaccctgcatggttttttgtaaaggctggcggtctataaacccgatatccccgttgcttacctgaactttatattgtgtccgggtagaatccagaagataaacaggggcttctgtagaaaaaattcctaaaagatctttgttatttcctttttcacggaagagatgtccccattctgatgtataaaccggcttttcacctggtttctgggccatggtattgtaaaagcagcattgaatgatgccggctcctaataatatctttttcaacatattgtcattggtgcaaacctttttagaaaagagtttgttattattatactgttatttccttcaaaattactgaaaaatcaagggttttcctattattattgttattcagaatcggtataaattccatgctattcaccatcttccattgggtaaagtaaataaaaatactatttttatcggccaaaaaaagtaaagactaattatgccgactgatgcttctcataagctgattccgatgaccactttcgtgctggagtattattctcacgaaggatatgccgatcttcagattttgaatctgatgaataattatgccaatttcttaaagaagcgtttgactcttggaatgtttgttcctgtagaccgtaaagggaatattctgaaagaacctaaaaactacaaggaatggaaatccctggatcataatgacgggaaaagaacggatgttattggatttgaagaatatgctgaatatcagaaggcggaacagaactgcatgtttgaaggctttaaggtagattataacgggtattcaaaagtgaggatcatcgctgcatatgatccttccattgaattatcttttaataaaaatgatctgattcctacgggatataatgatgtggaatcacttactgtttttgatgatatttttttaacctccagtgcattaaaagcgatcggaataagaagataaaaacataaatatttaaaacaaaaacgtttatcagtctgataaacgtttttgttttttgatatactatcgtacacattctcccgaatgacaatgatagcctgaaggacacaacccgttaatgcaagggcctgcagcatcagggtaacatctttcatctgcccggcaatgggaatgaggcgggcacagagacagcaggtttccaaggcaaacgcctaccggaagagggagattaagttcaataccaatttctccgatcatgttcttcaatgtttttctgtttaattttttcatggattttgttttaaggtgttattgatttattatattttcaagttctgtgataaaatctttctgtgctgtattgatgcgcttttgtgcttcttctgaagggaaccattgccattgatctacttccgaaacttccattattttaccggatctgggaggccattccaatggaaaggtattactgtaaagatcggcagtatcaagatcgctttctaaggcccaggcatatacggtttttcctcctttctgcttaataggcgacagttcgataaactttccatctatggttttaccggtttcttcttcaaattctgtcaaggcgcgttgcaatggattttcatcagcaagaatttcccctttggggatagaccatgctccaaggtctttatttttccagaaaggaccgccgggatgtaccagaaaataatacagactgtttttttcttttttaaaaagtagaataccagcactcgttttcatggatgtaagggtttgattattaaagatatgaaaaaatatataaccgtatgatcaatatgatatacttttctttttaaactcagagggggacatttgtttgtacgttttgaatattttattgaagtggctggcatcattgaaacccagcttgtcagcaatttcactgatattataacgactttgaagcaaaagcttttcagcagtttttattttatgctgcataacgtgctgctgtactgagaaaccagtttcctttttgatataaatgctgatgtaatggggcgaaagcataaattcttcagccagattcccgattttcattttatcagcatccagagcgttgacattgatatagtacagtatcttttcaattctgctcagattttgggttatccattctttggcagtactgttatttattgtattccggatcaggatcgtaataacggatgaaaaaagatcagcagtaatctccttattataggtatttttatggctgaattcataaagaagaatccgggctagctgtaacagatgggctctatctgttttattcttgattacggactcgtagacaaaagaatggtcttccatcagaatctgtactacttttttaagctcattagttttgttggacaaaaggttttgccagatatactgctcagtaaattttatataaatgaaacgagttttacttgtaatggtaaattcatgggcatcacttggcctcaaaaggaaaacatctccttttttgtaggaaaaagttacgttgttaaggtgatgaaatcctttgccatgttctatgataatcagttcataaaagttatggttatgatactcaacatcccatatttccttttcaatactgaaaacattaaaagaattaaagttaacgattcgtttcataatagaatggatttttacaaatttaccattaatttttacaatacagactgagtgattattgatgaattttgccttatcaatacattcaaaatgaaacatataaaacaatccgtattgttgcttgcttcaacaatcgttttaatgtccttttctgatgctcatgataaggataaaagagagaaaaaagagatgtctcaggcacaggctccggccaaaaaatactggccgaacggcgctcagctggttatttccgtttctatgcagtttgaaacaggcggacagcctgaaggtgctgaaagtcctttcagcgggactcccctgcccaaaggacaacctgatcttcccgcagaaagctggtaccggtatggcggaaacgaaggaatttacaggatgctggatctatggaaaaaatatgatatcaaagtaacctctcatgtggtgggaactgctgctgaaaagtatcctgatgtggcaaaagctattgcaaaaggaggtcatgaaattgccgctcatggcattgcctgggataatcaatggaataaaagttatgctgatgagctgaattttgtaaaacagggtgtagatgtggtggaaaagattaccggtcagaaagcggtaggttataactgtaactggctgagaagaggcccgaatacgcttaaagtattacaggaactgggttttttatatcatatagatgaccttagccatgatgagccttttattacaaaagtaaaagggaaaaattttgtagtcattccctatacgttacggaacaatgatatcgttactatagaaggaaagcattggagtccggatcagtttctggcacagctgaagtttgaatttgatcgcctttatgaagaaggagcttctaagagaaggatgatgagcatcagttttcatgacaggattggtgggacaccggcaatggtgcatgccatggaggaattcatcaggtataccagagaaaagcagggtgtcgtctttatgagaaaagatgatattgcaaaaatggtaatgaatgatcccgatactccggtcgataacagtgaagaaaagtttaataagtaataagttataagtaaggaagctggaagcgggaggaagggagttattgaaatctgtaaagtagttttgtggtctgtataacttccatcttccatcttcgtgcttccatcctaaaaaaatacctttatgaataacacaaaaacagcctattttttccttcgtgtgtcgatgggaatcaattttttgggacatggattggtccgactggtaaaattacaggattttgcatcaggaatgatgaaaggttttgaatcaagctggcttccacaaccattagtacacatgtttggtgtcacgctcccttttctcgaatttacaattggtctgctgctaataattggatttaaaacccgtattgctgccatggccggagcctccctgattatcttactcctttttggaagcagtaccgttgaaaactgggaagcaatgggaattcagatgatctatgcaggtctgttctatattctgatcagcagaattgaagataattacctggctttggatcgaaaataaaaacagtatggctgaaaaagtaaagaattacacctgattattataaagttgtttaaactttaccaaaccacaaaaggcacaaaaggcacaaaaggcttcattttaaaacactttagtttatttaagcaagttcaaatgatcccacaaaaaagtacaccaaagtttggttctgaaaaaattggagtatttaaaactttttgtgccttttgacttcgtcgaatcttcgatttgtggttagaataatgattcaatgctgtattttactttctcagcctgattatttttttatattgttcagagattatgttacaactttcatagattcagttactctgtttttataattatgcccgaattttgtatcagaaataaaataaactgaaagtattcaatttattttctgtaaaatagctaaccctcaaaatgaaaaatgatgcaaactatattgggagccaacggacagattggtgaagaacttgcaagagaactgaagagaaattatacttcagacatccgtattgtaagcagaaatgccaaaaaagtgaatgaaaccgatactgtattttcagcagatttatcagacagacaacaggccatagaagctgtgaaaggaagtgaaattgcatattttacccttgggcttcctatggataccggtttatgggaaaaacaatttttgatcattttaaaaaatgttattgaagcctgtaaaatcaacggaacaaaactggtcttttttgataacacgtatatgtatcctcaaaataatgagattctgacggaacaaacccgttttgatcctgtaggaagaaaaggaatcgtaagaaaacagatggcagatatgcttttaaaagaaatgaaggctggtacaatagacgctgttatctgcagggctcctgagttttatggtcccgggaaaactcaaagtattacgaatactcttattttcaacgctattaaagatgataaaaaactaaaggttcctttgaaggatgataaaatcagaagtctgatctggactcctgatgcgagccgtgcaactgctctgatcggaaacactccggatgcctatggccagacatggcatttgccggtagatgatcataaactgaattataaagaatttattgctttggcttctcaggcctatggaaaagaattcaggtattccgtaatcccgaaactgctttttgcaataggatctttattcagcaaaaatgcaaaagagctattggagctgcttccgagatatcaatatgataatctttttgatgattcaaaattcaggaaaaggttcccggaatttcggataacttcttacagagagggaattgaacaaattaaaaaagaacagcaaaaagcaaaagaaaatcattaaaataagtaacttagaaacaccatcaccacaaccgaaagggaatatccccttctttcgaggggtggtaaaaaaataaacaaaatgaaagctcccgaaaaagtaacttccatcacagcattgcataagtatctgaacctgaaaaggccttcacatcctttgatcagtgtatttgattttaatgaggtgaatattgatcctgaaacgatcctgagttcagtaactacagatttttacgtagtttccattaaaaaagattgtgcgggaagatgcaaatacggacagcattattatgactttgaggatggaatcatgtattttattgctccccatcaggtactgcagtttgaagatatactgcttgctgaggtaagaggaaatgtactggttattcatccggattttctgcagggatatccgctggcttccacaatcaaagattatggctacttttcatatacagccaatgaagcgctgtacctttcggaaaaagaagaaaaatccgtaacggatatcatggataatatcagcagggagatagaagccaacatggatagtttcacccaggatttgctggtttccaacatcgatttgctgttaaaatactgtgacagattctataaccgtcagtttttaacccggaaaaaagtgaaccatgatctcctgacccagcttgaaattttactggacgattatttcaaaaatggaaaactgctgaccgacgggattcctacggtacaatttgtggcggctcagatgaatatcagccccaactatctgagtgatatgttaagggttcatacaggacagaccacacagcagcatattcagaacagggtgattgaaaaggcaaaagaactgttgtctactaccccaatgaccgtttctgagattgcgtatcacttaggatttgagcatcctcaatccttccatcgtttatttaaaaatcagactactgtttcaccgttggaattcagaaaatcttttaattgatcgtatcatgaaaaaaatattattaatagtaacgaacgtagatcagtatgccagcggtaatcttaaaacaggtttatggctgagtgagcttacccatatatatcatgcagtaaaggaaaaaggttggcaggtgaccatagcgtcccctaaaggcggaaatactcctgtagacccggaaagtctgaaacctatggtccttgatggaatttcaaaaaaatattatgaaaaccccgaattcatgaatgaactggcccatacaaagagccttgatgaggtaaagaatgaatctttcgactgcatttatctggccggcggacatgcaacgatgtatgatttccctgataatacaactttacaggcaatactccgggaccaatatgaaaattgtaaaatggttgcagcgatctgccatggagtcggaggattattaaatgtaaggctttcggatggtgaatacatgattaaagataagaatatcacagggttcgactggtttgaagaaactctggcaagaaggaaaaacgaagttccatttaatctagaagccgcccttaaagtacgggatgtacattataaaaaagcttttattccgatgacttccaatgttgtggttgacgggaatctgattacaggacaaaatcctttcagctccaaggaaatggccaaagtagtagtccgtgagcttgaaaaataaaactagcgatgatatgattgtatttacaattcttaagaataatacagaagtaaaaacgcaaagtttaaagatgtaagccttttaataaagtgagcaaagggttgctactatgtctctgatgaagctttggctatgcatccgctcgaaaggaagcaataaattgattccttatgataaaaaggattttgttatcgtcaccagactcattatgatcactactattcccactaccacaaacattttctttgtcggaagttttgccgtaagcatcgctgaaaaaggagcggtaaaaacgcctcccaataaatgccccaaaacaatattccagtgatggattccaatagtgaaaataaaagttatcgcacttgttacagtcaagagaaacttagctacggtagagcttcccacgacataacgtggaatccttccctctttgatcagcgttccggttaccaaaggtccccatcctcctcctgcaaaagaatctataaagcctccagccaatcctaatattctgagattagttcttcttttggtttttgcctgtcctaactttttatctttaaatgcattttttaaaatattaatcccaagatataaagtatagcaggcaataataggctttacaatatgagcataatgttcgccatagtgagacaaggttaaagcaccgatgacagagcctacaatagccaatggaaacagtacccaaaccattttcttattgacatttcccagtttataatggctgaaacttccggcagcagtagtaaaagattccgcagaatgaatgcttgcactcacaacaggtggcggtacattcagcagtaaaaggatggtagtacaaattactccatagcccattcccatagatccggcaacaatttctgccatgaaaccggcaaacagcatccagtaaaaaatatggccgtctttgttcagaaaatactggatatcatctgaaagatcaaattgataaacgacaagtccaaataatccgaaaagaagtaaaacacctatgatggccagatagatattggcttttctctgggctgttttggtaatactgatcagtttttcaatttctttgtccggttttgaagaaacttttccatccgtcaggtattctgtcgtgattttgttgagctctttcactttatagttgaaatctccggtcagttgattacggatatgctgcatattgtccagcacatgatccatttcatcagggataacctctgtaaaggtttctcttaatcttttagcgatagtcggcgatttcccgttggtggaaatagcaattttaagacttccttttttaacgatggaacctaaataaaaatcacacagatcgggcttatcggcaatattcaccagaacacttttttcctgggctttttctctgatttctcctgccagttcaatatcatttactgcaataatggccagatcagtatcgttaaaatcatgatcactatatgccctttcatgcagggtaatattggaaaactgattttgtaagattctgacctcagggataatttctttcgccaccagtttgatggaagtatccggagagtttcccagtactgactccagtttttcaagagcaacctttccaccgccaatgatcagcagtgaaaggttttcaagttttaaaaatacgggatataaagaattgctcatcctgattacagttttaagtcataagtaaaagcgagataatacagtcctccgatttcgggacctgctgcatactggaagtaacggcggttcagcaaattggtagctccaatcttaatattggcatgaatttcaggcagcttccatgtagcctgtgcatcaatggtataataagccggaatttccccggatgccaaaggactttcccacataaaactgctctgccatcttgcaacaagggtaaatcctatatttttaacaatttctctgtttcctatacttacattcaccatccatttcggagtgttgaaagcggtaataaacaggtctgagttattattggaagccagatcattataagaaacatttgtgttcacattataatttcctgtgatattgtaacggattccaagagatgtcccatagcttttgtaggtactgttgctgttggtatacaccctgtaacggtcctgtttgcttcggtcaagcatcgcaagaacagctgcattgcttcctacctggctgtttttaggaacggccacttctacctgcccaaggaaaccttcataaatattgtaataaaaatcccaatccagcaccagtttattattgaaaaaagtagacttatatcctacttcaaatgaattgatcttttcaggctgtaacttctgcagattggctactgttaaaagctgtttgttatcctgagctgcctgactttgggttttccctgcatccatgtctgcatttaccgctgaggtgaatttatcgatggaagccaatgtataggaattttccagatagcctaatccgtcatttacttttgaaaggcctcctactcttcttacatttccgttgttgacgaatgaaagggcttcaaataacgaagggaaacgatatccgttttgaaaagacgctctgaaattatgttctttaacaggagaataaaccacacttactcttggattaagtttggcttcaaattccgggtttctatcaatccgcaaggcggcattgatttttaatttatcatcaaagaaaagcttggtgatctgtgcaaaagctccatatttctgatagataacatctttcccgaaggtaccatcagctaaaggaatatttctttcattcaccggacggttgaaatcaacaaaattatttccatccggagtaatgctgtataaacggtaatccacaccgacaagaaggttgaatatcttcacaaatctgttgaaatcataagtaagctcaccctgataaaagcgggatttctgttcaagcttggctcctcctgttgccggagctcctgcaattcctgcattcgctgaatcccagttattgatgccgatgatggtgttctttaactgttcaaaagctgcagttcccggtacagccctgtttttatcggcttcccggcgggcaaggataaaagcatcattaagattggttccggcgttcagactgttctgaagtgcagtctgaaatatatttttccagttggtattggaaagattggtcagatcaagattatctgctaaaggtttcaggttataagaatctcctgtattttctatggatacatacgctctgaatgttaattcttttcctgtcagctccactttatggttctgaactgtggcattctgcagacggattttattccctctctgaaaagttccgtccagcaagccgtaacgatacacataggatgctctccactgatctccaaatcgataatataaacctgcgtcaaacttgatatttttcacatcagggcttaccagatctttttccagatagcctgttctggaaacattgaatgtggttggttttccgttgtaatccacttttacggcaacacggttgtttctttcatctccatacttattccaaagatcttcagcaggattattggcaagggcaaaattaggattggcggtgactaatgatcctgaattctgatctgtcaggttgtttgagatccagtcggttccactgaaataagaggcattgactttaacagcaaaatttttattgatcacttttgcaaagcggatggcactttctcccagggaacttattttatggttgacattatccacatgatttactccgccacggaaataaacgcttattccttcagaagtaaacggatctttggtctgtaaacttgccagcccgttaatggcattcattccatacaatgctgaagcagctccgggagttacttccattgactgaatatccagttccgttggcccaatggcatttcccaatggtacacctaatgttgcagattgtacatcaacaccatcaaccaactgcatgaaacggaaattgttcggcgaattgaaacctcttgaattcggaattttcaacgtaagactggaagttaacagctgtaatccttttacgttttccagggtttcataaaacgaagcagccggactttccctgatggttttaatatcaattttttcaatcgcgatcggtgatcttaatatcttttccggaactctggaggctgaaatcaccacatcatcaatgattgtgttctgaggattaagtcctaccgttattttgttggaaggtgaaagtatttcaaccgtctggctggtaaaaccatctttctgaatcactacccgaaaaggaatggtaacccttgttctgagcttaaaattacctgcctgatccgttaatgcggtatcctgcgtgttttcgatctgtacttttacggagtcaagacctttgcttgttcctgtgtttttgatgcttccactaagctctataagttgctgctgagcttctgccaggttaaaaaatagaaatgtaaatgcaataatgcctgcttttggtagaaaatttccctgctttttgtttttcatttttcttcattttttaggttgagaatgaagctgcctgaatttttacattgattatttttaccacaaaaggcacaaaagttttcattttaaaatactttagttcaattatgtaagcttaaaatgacactgtagaaaagttcacattagatgaaaatcaaagatttttacaaaacttaggtgtacttattatgcacaaagtttggctcttaaaaagcttaagtgtttaaaacttttgtgacttttgcggttttgaatcgaaaaacttcaaatagctttgtttgtattgttatttgagaatcaacaacacatacacattcgtccgcctaaatgaagaggttgattatttttgttttttttcagatcataatgaaaattagccatataattaatttaaggtgtgtaagtaacggtatgaaaaatcaccaaatgtttcctctgccagtcttttctgtacataaatcccgaaaagttcatccagggtggtcagaatttcttcctcgccaatgttttctttaaattttgtattcaatcgcattcctaagcggtctcctccaatgtgaagattatatttcccataagcagttcccacaaatccgatttctgcattaggggatcttccacagccgttgggacaacctgtcatacggatcgtgatatcttcttccaacaaaccatatttttcaaggataggctctatttttgtgaccagtgaaggcagataacgctgtgcttcagccagtgccagtgaacaggtatttaaagctacacacgccacagagtttttacgtaaagcacttgctccgtcggtatgttctgaaattccgtgctcttttaaaatgtcttcgatttcaggcttatctttttcatcaatatcagcaaggataaggttctggttgcaggtaaaacggaaattcgcttttcctgtccgcgcaatttttaataatcctgattttaaaggatattctgctgtattaaggattcttccgtgttctacaaagaccgtataaaaccattttccttcatgattttgaatccagccgtagcggtcttttctttgtgtaaatgtaaattcacgggccggttcaaagctgaatcctgttctcttttccacttcagctctgtactgatcgatacctaatttatcaatcgtgtattttaatcttgatagtttccggtcacttctgtttccaaagtctctttgtaccgtaatgatttcgtagacggcttttaatactttttcttccgtatctaaaaatccaaggatagaggcgagacgggcataagtagcttcatatccgtgagtggcacctaatcctcctccggcagcaatattataacctacgattttatcattttctataatggcgattaaagcgatatcattgatgaatacatccacatcattattgggcggaacagcaattcctattttcagttttcttggaagatatctgtcctgatacaaaggatcttcctctgctttacggtctacaagaagttcatcatcaatccagatatcatagtaagctttggttttcggaagacacatttcactgattttacctgccagttcgtaggcttcctgctgtaaaggggattccgaaggattggctgtacaggttacgtttctgttgacatctccacaagcggcaattgaatccagatgctgaagattgaaactctgaatggtaggtcttaaatgagattttaaaataccatgcagctgaatggtttgtcttgtggttactttaatggttcctgttgagtgatcttcggctgtttcatttaatcctacccattgttctggagttaaaaaaccgccgggaagtcttaatctgatcatataagaatacagccattccagttttttggaggcacgctcttcccttctgtccctgtcgtcctgctggtacattccatggaatttgatcagcgtctgatcatcttctctgatcgctcctgtgaagttatctgcaagactttcctttaaagttcccctgagtccgttactgccggttttaatcctttctaccggtgaaaggttttctttatcgttgttcataactgtttcctttaattttttgagtacttcttttaatacacatctttagcatatctgccgcttaattccatttcttccaggtaggttaaagcatcttctttgctacgctttccttcattctgtattatggtgagaagcgtttgttctacatcacgggccatgggttctttagcaccgcatacatacacagatgctccgccttcaagccagtaaaatacttcctgagctttttgttccaacctgtgctgaacatatactttttcagctgtatctcttgaaaaggcaagatccagatgcgtcagactgcctgttttaagaaaatcctgaagttctgcctggtaaagaaaatcggatacaaagtttctgtctccgaaaaacagccagtttcttccttctgcacctgtggcatcacgttcccaaaggaatgacctgaagggcgcaatacctgttcccggaccaatcatgatgatatctttatccgcttcaggcagtttgaaatgtcctgcttcctgaatataaaactctatttcccctccttctttgaattcactcagaaagccactgcataatccattgtgcttctgatgatcaataaagaattctgatttagctaccgtaatatggatttcggtatcgccatgagcttccggagaagaagaaatggaatacaggcggggcgcctgagcggttaatatctgtaagatttcttcaaactcatcggcattttttacgggataaattctaagaagatcaagaagacttaatctgacttccggaatggaatgtcctgttattttcgcatattgagcaacaactgatttcagtaaataactgatgttgagttttttatgcaacagttcttcaacagaagctgtaaccttcggtgtttctacctgtttttgaggatcaatcccggtcagcgcaataatttcactgactatttctttagcattgaaagggattattcccaacgcagcacctggttgataactaagcgcttcttctgtttcaatttcaatatgatacgtttctttttcagaggtaatgtcattcagattgatgatggctgaaacttttccctggtattttttccttccggtagaaacctttggagctgaaatattttttgtaccctgccccgcatttttattgactgtttcaaatacattctctatccagtgggaagcttcctgttcataatcaatatcacattttttcaatggaatcatgcgctgagcacccagtatttcaaagcgtgagtctacatcttccccggttttacagaacagcggataactgctgtctcccaatgccagtatcccatatttaagtccgctgagatcaatttcattctcatgaatataatcatagaattttttggcaagagccgggggttcgccttctccctgagtgctgatgactacaaaaaagaactcttctttagccagatctttagacttgtattgggaaaggtctgcgagttttacctgaagtccttttttctttacgatacccgccaatgctgtagcgagttttttactgtttccggtttctgtaccgtaagccagtgttattttctttacaacattctctgcgatatcatttgtttgctgtggtggcagaacagcggtcagtgaagatcctccggcaatacccgcaagatatccgctagcccagatggcttcatctctggaaagatctgtggagatttgttttaatacgtttaatttagtttcagacagcatattcaaagaaattttgagtggtagggatcagacttccgttttccactgatttaaaataaagaccttcctgctcggcattttccaaccatgaaaattcttcgtggagatttacaattttgcctactaccaccaatgaaggggaagcaaagtttttgtctccgaatttttcattaaaatcatcaaatgatgacgtgtacaccttctgaaaaggcgttgtagcctgttcaatgactgcaatttttttatcacctgaaatctgaagagctttcagtttttccaccagaggagtaagattttctttagacatatagaaaacaagcgtgtcattggttaaggcaagctctttccagtattcttcacttacgatttccgatttataataggtcagaaaacgaacagatgtagaataacctcttgctgttaaaggcatccctgcaaacgctgctgctcctaaagcggctgtaattcccggaatgatttcgtaaggaatatgattttcttttaaagcctgtaactcatccagaatattggagaatatggaaacatctcctcctttcagccttacaatcgttttattctggcgggcatattccactatcaaagtattgatatgagattggggtgtggaagcatttttgctgcattcttttcctacataaatgatttctgtgttttcattaacgtaggtttccagaatttcaggacttacaagacggtcgcataaaacaacgtctgcttctgcgattgcttttacagcttttacagtgatcagttcagggttgccgggccctgcacctataaggtaaacctttggtgattttatatttgttttcattgaagtaggtgttaattaaggatttagaagagtccttctacagagagatacctttctcctgtatcataattgatggtaaggattttagcgttaggtggtatttccggtaaatgtttggcgatagcggctaaagcggctcctgtggaaactcctacaaaaagaccttcttttttagcggcgttaagggcatattcataagcctcgtcctttcctactgtgatgacaccatctaaaagtgttatatccagaatggaaggaacaaagccagcccctaatccctgcaatggatgtggtgccgggctacctccgcttaaaacgggagataattcgggttctacggcgaaaacttttacgtttggatatttttctttaaccactttggcaattccggtgatgtgcccaccggttcctactccggtaatgatataatcaagaccgtccgggaaatcttttaaaatttcctgtgctgtggtttctacatgtacttttacattggcaggattgtcaaactgtcttgggatccatgagttgggcgtttcttccgcaagctcattggctttttcaatggcgcctttcattcctttttctcttggggtaagcacgaattctgctccgtatgcttccataatcttgcggcgttctatactcatgctttcgggcatgacaagaatgagtttgtatccttttacggcagcagccaaagcgagtcctattcccgtgtttccgcttgtgggctctataatgatgctgtctttatttaataatcctttggcttctgcatcttcaatcatcgccagtccgattctgtctttaatgcttccgccgggattgtttttttcaagtttgatccagacttcatgatctgaaccgaagagtttgttgattttcacgacgggtgtattcccaatcgtttctaatgcattcttaaatttcatatcaatgtactttttatttttgtttttttaaatcacaaaggttaatgattccggtaatgaagaattatcctttatttttatttcacttttgtggtagaccagagagttggcaggaacatcctgtgttacccatacatttccgccaatgatgctttctctgcctatggtagtttcgcctcccagaatagttgctcctgaatagataatgacatcatcttcaatattgggatgtcttttctgatgggctttttctttggaaacattcaaggctccgagggttactccctgatagattttgacattattcccgataaccgttgtttctccgatcacaattcctgttccgtgatcaatgaaaaaagatcttccgatggtggctcccgggtgaatatctattcctgttttgctgtgggcgtattctgaaatgacgcgtggcaatattttcaccttctgagtccagagctggtgcgaaatacggtagacatacgtggcaaaaaagccgggatatgccaggtatacttcttccagtgagtcagcggcaggatcaaattccagaatggattttgcatccaacaccagctgatcataaagtcccggtaaagcttcaaaaaactgactgacctgtttttctgtaagatctttatctcctgttacagtattaatctgatcagaaagtgtttgctgcaatgcttcaaaatttcttttcagttgatcttcagtattgtcattctgaggaaggaagagtgtttcatacaaatccttgacccattttttggtctttattttatcaaagaatccatgaatactattgtgtttggtttgatgaattctttctgtgagttgatcggaaattgccattttttctattgaattatgcaggctgctaccgttgaattggacgtttcatccaccagaatggcagagcccgttgttttattattggtaaaactgtcatagaccaaaggctgtgccgttcggagggtaactttcacaatttcattgagttttatttcaccatcggcctcttctctgataagagtattaacattgatcttgtaatctatctctttcactactgcttttacaagtctgctgttctgctgaagaagatatttatttcctggctgcagaggtttttgatcaagccagcataaaaggatttcaagatctttttcaacggccggaacatgttcttctgtaacaaaaatatctcctctgctgatatccagatcatgagcaaggtggataacggctggctggccttcaaaggcttcttctttttcaacgccattgatctcaatcttcgtaatttctgtggtcagatctgccggaagaatatggattttgtctcctttggtgaactttccgcttaatatttgtccggcatagcctctgtaatcgtgcagttcttccgtttgaggacgaatcacatactgcacctgaaaacggcttccgttatttttttcttcattgattgttacttcttcaagatattccagtaaagaagttccttcataccactctgttctggaagattttgaaacaatattatcaccttttaatgcagagatcgggaaataccttacgtcattcagtcccagattttctgcaatttttgcatattctgatttaatgttttcaaaaacttcttccgaataatctaccatatccattttgttgatggctacagcaacttttttcaactgtaataaagaagcaatgatggaatgtcttctggtctgttcaatcacaccttttcttgcgtcgataagaataaccatcaggtcagagtttgatgctccggtgatcatattgcgtgtatattgtacgtgaccaggtgcatcagcgatgatgaattttctttttgccgttgaaaaataacggtaagcaacatcaatcgttattccctgttctctttctgcacgcaggccatctgttaaaagagcaaggtctaccccatcttcatttttgtttttggaatgtttttcaaggacttccaactggtcctgcaaaatacttttgctatcgtaaagcagtctgccgataagggtacttttaccgtcatccacgcttcctgctgttataaatcttaatatatccatccgaattttaattataagtaatgagtaatgggcaatgagtaatattttgctgttttaagaagtaaaggtgtttatcctattacttattactcatcgctgattgcttatctaaaaatagcctcctttttttctgtcctccatggcggcttctgttaccctgtcatcaattctggtttcgccacgctctgaaattctggtggctacgatttcttcgataacggcatctatggtaacggcgtcagattctacggcagcggtgcatgtcatatctcctacggttcggtaacggattttccttgtagtgatgatatcttctggttccagtacaacatgggaagaattggccaaccattgtccattaaagtcgattacttctctttcatgcgagaaatagatggatggaagggcaatcttttctcttcggatatagttccagatgtccagttctgtccagttgctgatagggaaaactcttacattttctcctttgtggatttttccattgaagatattccaaagctcaggtcgctgaagtttaggatcccactgcccgaattcatcacgaacggagaatatcctttcttttgctcttgccttttcctcatctcttctggctcctccgatgcaggcatcgaattcaaattcttcaatggtatcaagaagagtataggtttgcagccagtttctgcttgggaatttacctttggcttcagtcagttttttactttttatggtgtcttccacttttctgaccaccagattcacatccaactgctgtaccagctgatcacggaaatccagaacttccggaaagttgtgcccggtatcaacatgaacaaaggtaaacgggattttcccatgaaagaacgcttttctcgccagatgcgccagtacaatactgtcttttcctccactgaataacaacgccggacgttcaaactggcctgcgacttctcttaatatataaatagattcagcttctaactgatctaaatagtttaactgatgtattgacatttttttcttttttattgatgaatatgcagaccgcattcttttttattggcatcttcccaccaccaccggcctgccctgaaatcttctccttctttgattgctctggtacacggttcacatcctatacttacaaatcctttcttgtgaagatgattgtaaggtaaatgatgatcttttacataggctgtcacctgttctgtagtccagtgaaggataggatggaatttgatgatcttgttatccggatcccattccagctggggcatattctgtctgttgggagaatgctccgctcttagtcctgtaatccataccttatatccttccaaggctttttttaagggatgaacctttcggatggtacagcatgctttcctgttttctacggattgatagaatgaatcaggcccgttttctgtgacaaattctctgagttcctccgtgtccggataataggctttgatgttctttttaaaaaacgccttcgtagaggtccaggtttcataggtttgttcaaaaagtcttcccgtatccagagtgaatatttcaatatttaaatcttttatcagatgagtaatgacctgatcttcgtaactgaaactggtggaaaagatcaccttatccgggaatttttcagccagtaattgcagtccattagtttgaaaagaagcttcatcagcctcttttatcagattttcgaattcatttttcagactgttttccattttgaattgagatttaagtcttgcaaatatatataaaattctataactcctatcaaaatagtagtatttaaataaaaatttttttaatctttattaataaacttagtcaaagtggcttccatcatgcttgttctggtcttttcacgaacgatcattaattcttttctcaggtagcagacagcttcatccacacaatcatcgcaagcttcataaaagtttaaagaaacacatggggtaagcgcaataggaccatcaaaaatacggtaaatgtctgctaatgagacctcatcaggtgatttcagaagataatatcctcctactttaccctgcttgctgttgacaagcttggctcttttaagctcgagaagaatttgttccagaaatttcctggggatgttttcgtcctgtgcaataacggaggttggcagaaagccctggttataattccttgctaatctgaccattgctttaagcgcatatttgcaacgttttgacatcataattgctgcaagttatgataaattattgtataaatgaaatgtttttatggctgaaaactttgtattttaaccacaaatcgaagactcgacgaagccaaaagccacaaaagataaagccatttaagttgcttttatggttaaagataaatagttgagaagttcacttagtttgaaaaccttgatttttattgatatacaaacctctgtgtaaatcagtgaaatcttcaggaaaagctaaccaccccgtcaaaaattctttgaattttcgccactcctccacaggaggggaattgtgagttctacggttctgagggatcagatctgtttactatttctgtaacataaagtaagccagttccctatccaccctttttagattctcaattcttttaaagttgttgttcagaagaactttctgagatccgatattatcaagatcggttacagcaacaatatctttctgatgattcagtgaggaacagtaatcaacaagcgctttacaaacttcagttccgaggccttttccccaataattttctcctaaagtatagcctatttccagctgatccggattgtcaagaaagattctggccagacacattcctacaaaatcattgttttgagtgttgaatattccccatctgctgaatggtccttctttataatcggctaaggatttttcaaacatttccttatattcttcaggagttttgtagggcagatagcgggttacattttcattttcaaaaagagtagaaaataatgaaaattcttcaggggcaaattcacggataatgatcctctcgtttttaaattgcattgtatcgtaattacagaataaaaatacgtaaataaatgaagaactgttcataaacaggataaaaaagattgggcttacaatgaagcccaatcaaatagcatatgaatgctgatctattttttaatgaatttctgggaagatttccctaaagaagtttcaatatcaattaaataagttccgctcaggaagtgtttaacatcaaccttatccccaataacattagcattcatttttcttccaaacatatcataaacagaaattgacttaatttcccattttgttttaatattcaatacatcagaaaccggatttggatagatggatgtttctgagtttgttgtatcaacgtctgaagtggataataataatgcacaaggcgttgtaatactgccatttggttgtgtattatatgcaaactcagtgacagaataatttgaaccattggctccaacgctcactttgaaatagccgttaatatcgtagccttcgaattggtttctaaaaccaacataggctgttttaccagaccaggtagtataggtaggagtatacacatccagttgtccgggagtccaagttggataccctatattatttgcattcgttatggtggtacaggctggaattaaactaatattccgtgttcctgtttggcacactagtcctttccaataagtttccaattttaattgattggctccatagtaccaggcgccatagcctgcatcatcactaagctccggattaatgataaaatatttccaagttgctcctgagttggtggttactgttgttggtgttgggttggcataactttccagaggagtccctgtaactattttataaggatctttataagaaaaagttaatgctaatgctgtcgttgaccctagtgaagctgtgcctcctgttatagccggattcaggaatgtaatagatgaattcaggacctggcttttaggatgactggttgcagcaccattgatggtaagtgtagctgttgttgggcttgtaactactatagctgctgttagtcctgctggtaatgaagacgtgaaatgtgttcctgctgtaagagttgttccattgggtacggcaaatgttgctgaatttaatgtaattgttgattggggagcagaagctactgttccatctaatgacacggctccgttattgtttaagttctctgtaaaggtactgttgctaagagttaatcttggaggagtattggcaactccggttgcggctaagttggcaggctgccataaattcattcgcgaaggatggtttaatgctgctagcattctgttaacttgtccaatggtaaacattttataacaaccagaagaaccattgtaccccatatagttttcaacgtttactttctgtccgagacaattgtttccagcgttacatcccaatccggaagaagtattttctacaggggtgtcagcaactccgtcaccatcattattagggtttgcagttgaacacggaacattgaatgtgtgttgaagatttaaccaatgaccgaattcgtgagtaaatgtatcagaaaactcgtttgaagccactgttcctgaagcattaaatatataacgcccattatacaccactctggctgtatttactgaactcatgtatgaatccggataccaggcaactcctgattgatataaatctttattagcatatagatcattttggatatacacattcatatactttgtattatcccatgcatctgcgccaatctctgcatcatatccgcctccgttgccatatccacctttgaaaggatgaaaaatcacgccgcttgttgcttttccggttggatcaattttagctaatcggaattcaatgcttaatgcccctctgatagattgaaaatcaggatctacagtatttgaatcagtgttgattccattgaaatttaagttgatttgctgcagtaagtcaactactttttggtaatttacttttacattactttgagattctccataaatatgaaaaaccacagggataatgtaggttggattgttgatccgattattcaatgaatttttgtttggtcccattttttttatgaaatctttggtgtatttctcaaagttttcatattcagccttagattcgggatgcagttcaaaatgttttttcatcatttcatctgctttacactcgcgaggtctgttttcctgggcaaaacctattactggaaatagggaaacaagtactagtaatttaaattttttcataattttttggatttggttgttaataaattatttaaataatcaaattgtttttggtcataaatttgtgtgttatgtgatattttaactaaatctttcagggttgaatatctttatctcaaccgttggcttttggtcattggcaagttctgaaactgtttttccaaagatgggtcctaaacttaaacccatcataccgccgccgcctgcaataatcaggttcttcaattgggaagattgtcctaaataaggaagtccatccggagcgcagggtctgtagccaaaccatatttcagattctttgggtttctccatctgaaagtcaggtaaatattgaggaatggaccggacgataccttctacccttttcatattaatggtatcctgatgggaagccagttccatcgttccaccaaaacggatctgtccgttcattggagtcactgctactctggcttccagtaataaagcagcatgatttagagtattgaccggattttcaggagtatgcatgaatgaatatccttttccgggcattaaccggattttaatacctgccttttgagcaagctcaggtaagaatgagcctcctgtcatgacaaactggtctgcagtaaatttctgaccgttggcaataacagctttaatatggctgccggaagtttcaaagcctgttacctgatgatgggtatgaaaaatggcaccattacttttaagataagaaatcatttgcttcatcagtttcatggggttcatatggccgtcacatttataattgactcctccgattacatccagcctgacattgggctccaactcctgaattccgtttttatcaagaatatcaacgggtaaacccatactgattgtcttgtgggcaagctctgtctcttcttctgcaaatttctctgttttatagagcattaaaatgccgttctgattcagctcaaaatcaaattcatcttttttcgcaatctcattataaagtctgctgctggccagattaagatccctgatggctgccgcagaatagtcaacatgtttctggttagagtgtttcagaaacttcaatccccatgatatcagattagaattgagtgaaggtcttacgtaaaacgggcttttactgtcgaacatccagcgtattccctgagcaacaactcccggtgctgccagcggagtaaaatgactgggcacaatcatgcctgcattgccgtaagaacagttgttggtaagatcattctgttcaagaatctccacctgccatcccttctgcaaaagataatacgctgagcttaatcccgctattcctgcaccgatgatgagtgcttttcctttattctgtgtcatatgcctgttacattacctgaaaacccagccaataaggatcttcatcatcaataattatatgattatatccggtaattcttgcccagccttctactgacgggataatggctgcttttccatcaatagttgtggtttcttcaattctcccgataaactgggatcctatataactttcatgaatgaattcttccccttccttcagttttccctttgcataccattgggccattcttgcagaagttcctgtaccacatggtgaacggtccagagcattttcacccactaaaacagcatttcttccgctggctttaggatctgtaggtttacccgtccattgaatatggcttaatcctgtaatatgttcaatttcaggatggatgaactggtacttttcattaagtaattttctgataatctttccataatgaataagctggctggccgtaaaatcagaaatatctctgaagttttcctgaggatctataattgcatagaagtttccgccataagcaacatcggcttttattaatcccaggtccggacaatcaacttcaaggtcttccgcatataggaaagactttacattggtcagttttacagattttacttttttcccttcctgtacataatcgatgagaataagccctgcaggtgtttcaaaacgtaattttcccggaattttgggaacaacaagaccttcttcaatggcaatggtaaccgttccgatggttccgtgcccgcacatgggaagacatccgctggtttcaatatataaaactccgatatcgttattttcatctacaggaggatacagaatacttccgctcatcatgtcatggccgcggggctcaaacattaatccctttctgatccagtcgtatttttccataaagtgcagccggcgttccatcatggagtttccttttaaaataggggcacctcctgcaacaagacgtacaggacatccacaggtgtgtgaatctatacaaaagaatgttctgttcatgtggtttgtagttttagtgattctgaattcattattccatctaccattctgctgatctgcagtggattttcattcttcaactcatccggtaggaattcatccggccagttctggaaagaaatcgggcggacaaatcgttttacagcatccgggcctacggaagtaaagcgtgaatcggttgtagaaggaaatggccctccatgctgcatgccatacaccacttctactcctgtaggcattccgttgaataataatcttccgcatttatcttttaaaacagtaatcaatgtaccgttatcacgcacatcttcatgggtcgccgcaatggtaatggttaactgtccttttagctgccgggcaatttccataagttctttctctgtatcacattccacaacaataccaaatggcccaaagacttcttcactcaatatcggattattaatgaagtttttggcacgggtttttatgactgcagcacttccttcagtactttcagtatgtactgatgcaattaattcaacatcaggttgttctattgcaatgctcttgtttttttcgaaactttcaaaaattccttcgtgaagcattttagcgggagtaatttcctgaatttcctcttttaaggcattgataaaacggtcaagcgggtttcctttcaatgcaataaatactcccggattggtacaaaattgtcctactccaagcgttaaagaaccgatatattcctttgccaatgcttcagctttggtttcaagcaggttttgaaaggcaaatacaggattgatacttcccatttctgcaaacaccggaatcgggtcttttctacggttggcaatatcaaacaaagcttttccgccagtgaaagatccggtaaaggcaacagcccggatatccggatgctgagtaagataagtgccaatctcataagatgttccggtaatatgactgaaaatcccttcaggccatccaaatgctttaataaccgtagttatcgcatccgccattatctgtgaagtctgaggatgtgctggatgtgcttttataatgacgggacagcctgctccaatagcacttgcagtatctcctcccgcagtagaaaatgcatacggaaaattgctggctccgaaaacaactacaggtcctatgcctacattatattttctgagatctcctttttgtttttcaggccgggcaagatcaattctggcttccgtatagataccggcagcaacagcttttgcataacttctccattgtcccactgttctggatttttcaccggcaagtctggctaatggcaatgaagtttcggcatgagtaactgtcaaaagttcttctcccaaagcttcaatctgatcagcaacagcattcataaattcagccctttcactgatggtggtattcttcagaaactggaaagcttcagccgccatctgaatttttctgtctatatcctgtgttgatgtttcttcaatcatatctgtgtttctggaattaataataccggacgatttgctctgccttcttcaataattttttgaattctttcagcttcttctccgtgaagttcaagacgtggcgctctcacatacggattgcttattccttctgctgttgcagccagtttgatatactggataagtttagggtgaatgtcaagctcaagcaatggcataaaccatctgtagagggctacagctttgtcatattcgcctgttttaacataattgtacatcgccatggtttcgttaggaaaagcatctacaagacctgccacaagaccatcagccccaagcatcagggtttccagacagatcgtatctacgcctccgagaattttgatcctttttccaaaacggttgatcattctggttacattcgcaagatctcttgtagattctttaacagcctgaatagtgggatattcaataagctcctcaaacatttcaagggtaacataaattccgtaatctataggattattataaataaggatcggaagatctgtagcggaagccactgctttgaaatattcgatcacttcacggttatcggctttgtaacgcattggcggaagcagcatcagaccgtctgcaccgagttcttttgctttcctggcaaagttgactgcatttttggtggtattttcagataggttaagaatgacaggaattcttccctgcgttattttttttgcatatttcagcagctcaaatttttcttctgtttccaaagcactggcttcccctaatgttcctgcaaggataatcccgtgaacgcctgctttaatctgagcttctgtattaatagcaaacatttcaaaatcaatctttccttcttttgtaaaaggagttaatacagcaggataaatacctacccagtttagttttgtactcatatcaaataatatttattcaaaactaagtgaattttaaaacggtaaatgttaatattttaatatgtattaaccgtattttaacaggttgttttttattgctctacagtagcctctttatagtgtttaaggtattctttaggggaatatttcatgatagacttgaaaaccctgttaaaattagtaaggctgttgaatccgctattaaaagctacagaagaaatgctgtacatgttactggatgtcagtaatctgcaggcccgctgtacgcggagttcattaagatattcaatataggtgattccggttcgttttttaaaagatctgcagaatgcttgaggcgtcatacaagcttctttggcaatagcatcaagggtaagtttagtttgggtaaaattcttcttaataaaggtctgggcatctataattctttgatcatagtctgaaatatgattcggcagattcttttctgaagacaaaggaatatgcaggtgcctgttttgcataagatggtttagaatcctgataaaatctatgatctgctctactccttctgttttttgtaatgccgcaatgttttctccgatacttgttttcaatttaggagcgatctggaaaccgacttctgaatgggtaatgaaatttttaagttctccaaactccggaaggtcgaaaaatgcagcaatctttttataaggatcaaaaaaaatagagatggaatgaaccttctgtttttcatttttttcaaaattgcctctgaaaacatgggattgattggcacccaggtaaaaaatatcaccggcttcaaaattaaacagattctgctctatggccaatgttccccgtcctttaatgatccacatgatctgtgtttctgtatgtctgtgaaaataaggatagaaattaggcataatatcttcctggattcggatactcttgttggtgtcggcgggaacagagaattgaagacttttcatggttaggctgctttactgatataaaatatgcattaggttaaaatattgctgaagttaagcaaaatatgaacattaagtattattttaaaatccaaactttacatgttctttattttaaacaagaaacacttattaatggtacaaaattgtaaatttaaacctttaaaataaaaactattcataatatgttttcagcacaaacttatcaagatagaagagccgtactacagcataatgtagcgaacggaattttattatttctgggaaatatagagaatcctgtgaattttgagcacaatccttattatttccgccaggacagcacctatttatattatttcgggattcaggaaccccgtatagcagccattattgatattgatgaaaataaaaccatcatctttggcgatgagcttagtatagatgaaattgtatggatgggaaggcaggaaacccttaaggaaaaaagtctgaaatccggtgttcaggaaacgttaccttacacagaactagcccgatatatttcaaaggtacatagctccggaagaaaagtgcattatcttcctccgtatcagccttccaataaaattttgctgtcggatcttcttgggataaaaatttcagacctgcagccttctgtagaaatgattaaggcaattgtaaagcaaagatcaatcaaagaacctcaggaaatagaacagatagaacaggctgtgaatgtttccaatgaaatgcatctgctggccatgcgccttgcgaaaccgggaatgaaagaatatgaaattgccaatgccatccaatatcttgctgcgaataaagagtgccagatgtcctatcctccgattgtgacaatcaacggaggtattctgcataatcattaccgtcttaatactttaaaagagggagatcttttcctcaatgattccggagcagaaacggcaatgggatatgcaggtgatcttaccagaacatttcctgtaagcaaagcttttactacaaagcagaaggaaatgtacgaagtagttctgaatgctttcaataatgcccagcagcttctgaaaccaggtgttcgtttcaaagatattcatctgaaagcagctcagcatctggtagaaggccttattgatcttggactgatgaaaggaaacgttgaagacgctgtaaaaaaccatgcccataccctgtttttccagtgtggtctgggtcatatgatgggattggatgtgcatgatatggaagatcttggtgagcagtacatcgggtatactgaagaagaaccgaaagataccaaaacattcggtcttaagtctttacgtttaggaaaagcccttgaatcaggatttgtagttacggttgagccaggtatttatatgattccggaactgattgacatgtggcaggcagaaaataaaaatgcagactttattaattatgataaagtaaatgaataccgtaatttcggaggtgttcgtgtagaagatgatttcctggttacagacaatggctacagactccttggaaacgggctgattaaaaccgtagaagaaattgaaaattacagagctgaacatttagcttaattcaaatattatttatgaaggaaataaagaaactaacagccattgcattgtattttttgtgtttatcaccattggcagcacagaagacacaatggactccggatggcaatgcttattattcatttactaaaaaaggggttgaaattgtggatgtgctgcatcccggaaaagaccagacacttttaagcagcaatgaactgattcctgcaggaagttctgaagcattgaaggtacaaagctttcaggtttctccggatggaaaaagcttattgctttttgccaatacaaagaaagtatggagagataatacccgcggtgactactggatttttgacaaaaataccaaaaagcttacccagcttggaaaaggcttgccggcttcttcattaatgtttgcaaaatattctccggatggtaaaaaggtagcctatgtatctaagcataatatttatatcgaagatctttcaaacaatcagcagacaaagatcacttcggatggtacggatggaatgatcaacggtaccttcgattgggtatatgaagaggaatttggaacccaggatggtttcagatggtccccggacggtaacaaaattgcttactggaaactggacgcaagagggacaaaaaacttcctgatgattaataataccgatagtctgtactcatttaccatccctgtagaatacccgaaagctggtgaaaatccttccggatgtagtatctggttttatgatcttgcttcaggatctaccaggaaagctgatatttcaggagatgaggtacaacattatattccgagaatggaatgggttctggattctaaatctgttattctgcagcagttgaacagaaaacagaatcaaagtaaaattatcgtggcagatgcaggttccggaagcagtaagacgatctatacggaaacagatgcagcatggattgatataaaatcccgctggaatgataatgatccgagcggatgggactggattgataatggaaaagaattcttatggctgtctgaaaaggacggatggagacatatttacaaaatagatatgaacggtaaagaaacattaattacaaaagatgcatttgatgttataaagccggaattttttgatattcagaataagcagatctattttttggcgtcacccaacaatgccacacagaaatatctgtataaagtaagcatgaagggaggaaaagcacaaaaagtaactcctgaaacctatacgggttctaatgaatacacgatttctcctaacggaaagatcgcaatgtttaccaatgataacatcaataccatttcaataggttccgtagtatctcttcctgaacataaggaattggtagctgccaaaagatccgcaaaagcagatccatcgatagctaaagcagaatttttccaggttaccacacaggacggagttacattggacggatgggtagtaaaacctaaaaacttcgattccaataaaaaataccctattgtttttaccgtatatggagaacctgcaatgcagacggtaacagatagtttctacacaggctggaatggattatacacagggaatatggctgaagacggctatttatatgtttctcttgaaaaccgtggaactcctgcaccgaaagggcgtgaatggagaaaatcaatttaccgaaaaataggacagctgaatatccgtgatcaggcaatgggagctaaagcattatttgcaaaatggccttatattgatacgtcaagagttgccgtatggggctggagcggcggaggctcttctaccctgaaccttttaggacaatatcctgatatataccagacgggaattgcgattgctccggttgccaatcagttattctatgataatatctaccaggagcgctatatggggcttcctcaggagaacagagaagactttgttaatggttccccgctcgcttatgctaaaaatttaaaaggaaaccttttactggttcacggtacaggggatgataatgtacattaccagaatacagaagtgtatatcaacgagttggtaaagtataataaacagtttcagctgatgtcttatcctaaccgtacccactctattgatgagggtgaaggaacatcactgcatcttgccaccctgtttacaaaatttctgaaagaacactgccctccgggagcaaaataactctaaaagtctcacagtgatgtgggactttttattttaggtacgtttccaacaaaaattccccggagaaatctggggaattaaagtgtcaaaacctatattttttatagtggtgtgaatgatgttgagttgagagaaacaatgggtatgccaaattaatcactattttatgaaatgtgagttttgtggtatcttttgtttacaccgaaggtttttgttttatggattatcactaaatttgagtgaataatttctaaaatcattcatgaaactaccacgctcctattattccaatccggatgttctttttttggctaaggaccttttaggaaaagtactttttactgaaatcgacggggaaactacagcgggaatcattgtagaaaccgaagcctatttcggagttaaagataaagcttcccatgcctatggaggcaggcgtacagaccgtaccgaaaccctatacagccatggcggagtttcttatgtttatttatgttacggtattcatcacctttttaatgtagtgacttctgttgaagatgagcctcatgctgttctcgtaagagctgttgagcctttgatcggtaaagaaattatggaactcaggagaaatatgccggctactaaaccttctatttccgcggggccgggatctgcagccaaaactttaggaattgaccgttcatttaacaggaaaaaattaacggaaaatgaaatctggattgaagatcacggcattgcgtatcgaccggatgaaatcatcgcaggaccacgtataggtgttgcttatgcagaggaagacgcccttttaccatggcgtttctttgtaaaaggaaataagtatgtgagcaaaccgaataaggcataatatcaggattcatttacagtatgataaaactccttataataattgaccaaactgtcaagagtaaacccgcggttcaggccactggtgttgggtaaaacccatacttttgctccacagaagtcttcaggctgctctccccaaaggatttctttctttttagaaaaggccttgtaggctgctttgccaagaaaagctacatatttaggctgatattttattattttcgatgtgaaacttttaagtgcttcttcaaattcttcctttgaaagttcatcagcacgggaagttgctctttccacagcggttgtcaatccatatccgaaatccagaatagagatatcatttacggcttgtatctcataaggagtaaagcctgactgatgaaggactttccagaaacggttactccttccggaaaaatgaaagccgtcattagatgattttaatcccggattgattccacaaaaaataatatcgagatgattggcaataatatctgtcagcataattaaaagtacaatggtataaaaataaagagcagtatgattcctgctctttatggtttataaaagtttagttctgtaataaatttttctttaaaaattcttccagatctttgccgtgaagattcttagctaaaatggttccctgaccatcaatgatgatgttaaaagggagttcatccacttcataaagctttgctacagggcttttccagaattttaaatcactgatctgtatccagttgataccgaacctgtcaattgctttctgccagctttctttattcctatctaaagagatcccgagaatttcaaactgattgttctttaccttatcggaatacgtagcatacaatgctttcagctcaggctgttcttcaacgcatggagcacaccatgttgcccagaaatcgatcagaaccattttccctttcaatgtagaaagagaaaatgctgttccatctgctttggtcatcgtaatttcaggtgctctttttcctatttctattgctttctgggcatcaacagaaacagaaagaaacagcaaaaataatattgtaaaacaggtcttcatattactcatttgtaggatagtttttatccagccaatctgttttgatatttttaggaaggtttaaaagcttcgcatttttgaagcccagttccatcagtaatgtaaaagtaggacggatattagggcactttacgaatggacagcatccgcaatagattacgatttctctgtttttcggaacatcttttagataatttctcagtttttccagattttcaggctcatgagtggggccaatgtctacagaacctttgataatcgcttcaggacctactgaaatgattacgagatctttagtcttatgcttttcaattctggaagccagtaacgccggatccatcagctggctgtctttccacggatcctgtttttgctgtgcctgaccgaaaacggaacagacaaggcaaaccataatgaacaaatacttcatacttctatttttcacaaatataagatgaaaagttcagagttcaggccggctttatacgttgcattctttaatttttcttattttcaatctgattccgaataattttatacatttatattcagtatcattcaaacattttaacccatggaagaaacattcaggcctgatgccattatcataggcgcaggactggcaggacttactgctgcgatggaaattaccaatgccggaaaaaaagtactgctcctggaccaggaaaccgagcagaatatcggaggacaggctttctggtcattcggagggctttttctgatcaattcaccccagcaaagaagaatgggaatcaaagactcttatgagctggctttacaggactggaaaggaactgccggtttcgaccgtcctgaagattattggccgcgtcaatgggcggaagcttacctgaaatttgctgccggtgaaaagtatcaatacatttctaagctcgggatcaagctgatgtttatggtaggctgggcagagcgtggtgatggttcagcaacaggtcatgggaattcggtgccccgttttcatgtgagctggggaaccggtacaggtgttgtaaagccttttgtagagaaagcttataaagctaaggacaaaggtttgctgcagatgaaattcagacacagggtgacggaatttataacagaaaacggaaaaataaaaggactgaaaggagatatcctggaagatgatcataaaaaaagaggtgctgctaccaatagaaatgtaatttcatcatttgaatatactgctccgaatgttattattgcttcaggaggaattggagccaatcatgagctggtaaggaaaaactggcccgaacggcttggaaaagcccctgaaaatatggtttgcggggttcctgcatatgtagatggtaaaatgattggtattgcagaaaatacaggggctcatatcattaatcctgacaggatgtggcattatacagaaggtttgcaaaactgggatcctatctggccgaatcatggaatcaggatattaccagggccttcatctttatggtttgatgcaaaaggcaaacgcctgcctgctccttttcttccgggatttgatacattgggaacattaaaatacatacaggaaaccggcttttcctattcgtggtttattctgacccagaaaattatcaaaaaagaatttgcgctttcgggttcagaacagaatcctgatattaccaataaagattatcctctttttctgaaaaggatctttggtaaaaaagcaccgggtccagtggaagcatttaaagaacatggaaaagattttattgtatcggacaatctggaagaccttgttaaaaggatgaatgaactggctggaaataaccttctgaaatacgataaaataaaatcccagatcgaagccagggacagagagctggataataaattctcaaaagatacccagattaattatatcaggaatacccggaattacttaggagataagttgggtcgtgtagcagcgccccataaaattttagaccctgagaacggacctttaatcgctgtacgcctgaatattttaacccgtaaaactttaggcggaatcaaaacgaatctgaacggacaagtcttaagagatgatgacagtattattgaaggactgtttgctgctggtgaagctgccggctttggtggtggcggaatgcacggctaccgggcactggaaggaacttttttaggaggatgtattttctccggaatgaaagccggaaagtatatcgcaggacttaaataaaataatgagcagatatgagcagttatttcgatcataaagtcatctggatcaccggagcatcatcaggcattggagaagctttggtaaaaaacctggcaaaaaacagcagtgccagaatcattctgtcttccagaaaagaagatcagctgcattccgtggctgaaaaagcaggattaagcattgaccggtatgcagtgattcctttagacctcaaaaattataaggatatgcctgatattgcaaaaaaagctgcagaacaattgggaaagattgatattcttattaataacgcaggactgtcacagcgttctctggcgatggaaacggatattgaggtagataagcaactcattgatattgattatatcggaacagtagcccttacgaaagcagttattccttatatgatcaggaataaaggaggacagattgctgtagtctccagccttatgggaatatttggagctcctatgcgaagcggatatgccggggcaaaacatgcgttacatggcttttttgatgctttgcgggcagaattattcaatcagaatatcaggattactatgatctgtccgggttttatacagactgacatttctattcatgcagtaaccggagacggctcattacaaggaaccatggatgatgctacgaaaaacggaatgccggtagatatttttgcaggaaaaatgctgcatgccatccaaaagcagaaaaaacaaaaagtaataggaggaaaagaagtgatggctgtctatctgaaaagattttttccaggcttattggcaaaaataatccgtaaagcaaaagtggtataaaaaagctctgttcaataaagagcagagctttttcagaatgaaagtttgtatcaaaaggttttcaccagtcctattcctactgttttattttgataaaaaggcataaccatggtagatgataaagtctttttacttttatttcctctcaatacattgtcaatttttggaaacagccagtaagccagttctgtagaaaggattccaaatccggctcctgccacaacatctcccagccagtgcttatcattcagcattctgtatacagccgtgaaaacagcgaacggatatcctgaaagactcagccagaaattagtgtctttatactccctgaacataaactgtgctgaagaaaatgctgtagcagaatgtcctgaaggaaacgataaggtgttggaaccgtcaggcctttcttcttttaccaggtattttaagggcatggtaaaagccgcggcaatcagttgtgaagaagcataaataatagtacggtctctcagattgtgttttccttttatacccatggcattaagtccgtaaaccattactgccggagcgtattgggtataattatccagttttatctgtgcaggctgatgctcgttaatttcaacccgtgttgattgattaagatttttcaggtttttcatgcttaaacctgctactccataagcaatgaatgcggcaggaataatcaggcttttataattcaaagtgctttttggggcatctttggtcatcatactgtcctctacaggtttctgaacagatatcgtatcattggtattctgggcgttgatcctgccaatggctgaactcaaaaccattatataaatcagtgttttttgaaagtactttttcatcctaaatcgcattataattatccaattctgtattaaaatttataactgtatcctaaacggattacctgggtttcgtaataatcattgcttgtgtaggcaaatccatttccctgaacagactttctgattaccattgtgttgagcaggtctgaagcgttcataaacagttcgcccttccctttctgaatcgtttttttcactcctgcatccatggtaaatcttgactttgtttttccctgtggaatgatgtccggtgccagatatacaagggtaaactgcatgtccagtccttttgaaaaatgaaaaacgttattcattttgatatttcctgaaatggcagtctgccggtcggctgaaaaagcattaggctgaggatacaggttttgtacagtaaatgcgttgatctggttacggtatagatttccattaacattgaaagaatatacatctgatactttttggttccatatcgtttccagccccgtattatagcttcttcctgcattctggaatatcgcatagataagtgtgctgcccgggacaacacttgaaattctggtgatagttccgttggcaaaacgatgatacagtgcagaatacaaatatccgttagcccaattgtgtttgtagcccaattcaactgaatttgtaaactgaggacgtaatgccggatttcctaccttaatgatctccgcatcatcatattttggaaaaatcctgatatccacttcgttgggacggtctacccttctgttgtagaaaacagagaacttattatgatcatcaagtttgtatgccaatctgaaattcgggaatggctgggtataattatagccgtcacttttataggttggatggttaggatttacatcatactgaattttcacatattccagtctgagtcccaattctgcttcccatttttcattttcaaagacataatttccatacacggctggaataaactctttataatctgcctttccacccgcagaaacatccaacacagagttggcgcccggaataaaattcatattggtaggaatacttctgttccgaagcttaattcctgtttctattcgtccgtatttcaaaggttttacataatctacattgaaatcgtagacctgttcatccgataatagtttaaaagcatcagttccggtagaagatggcagataattatcatagaaatatttttcatcctctctatggaacgtatagttgaatcccacgtttaaaacatgtccggcttctttgaatttatgctgataggaagccgttcccatcactgttgttttcagttcatcctccagaaactgccataaacgcaaacgctgagacagatctccgttgaaaaacggttgatctccccggtcaataattttttcgcttccgtacattcctgaaatggttaatgtattttgaggatcaatattccagtcgattccggctttggtggtaaagaaattagtatttctgtttcttttcagctgggaattgataatggttccgtcatcatacgtacgggttacaaattcattcttgttaagggtctctgtatataaattgtcggcctgtaaaaatagattgaccttgttttttctgtaattcacagacagtgaagggttaattttaggcgtgagtgtatattgcggtcttatggtgggaagattctcctttcttacccataatgatcctaatcctgtagtgaaccctgcctttccgttccagccgttctgcttattctttttcatgataatattgatgattccggcattcccgttagcgtcatacttcgaggaaggattgttgatgatctcaattttatcaatggcagaagcagggatattatccaatccggtttggcttccaaaacctgtaagagctgtttgtttgccatcgattaatacagtaaccttatcatttcctctcaattgtactttaccgtcctgtacagtaattccgggaagattctgcatgctttgcagtacagaaccaccattttggctgatgttatctgcgacggaataggtctttttatcaaggcggctgtctatttcattctttttagaggctgtaatggtaaccgtctcgattttggtttcattttcctggtcctcagcgagctcaatatctggaatttccagaaattcagacaggctgccaataaaaacgggttgtatatgttttttataaccggtaagtgaagtttccagaatataatgatcaggttttagaccggtaagagaaaatcttccgtcttcattagtaatcgttccagctgcaaaggcactgtctttttctttttttaaaataatatgggcgtaaggtaatgctgttttgtttttaccggtaattcttcctgatgctgtcacagacattgtctgtgcagaaacaagggatgaaatgagcatacatgatgggagaaaaaacagggctgttctattcattttactattttattttcttttaaaatctattgtttaagtggttaactatgatttgttttcaattgatggtaattcacgggtatgctttctttgggaaataataatcatcagaaccatcagtgtgagggatatcagagatgcattaagtgttcccaggtccagtcctcctttaaccaggggtttggttaaaaggtcgccaaaggttgctccaaaaggtctggtaaaaacaaaagcaatccagaacaggagaacatgattgatttttgtgaaataatgcagcaggactacagctaaaataataagtccggtaatcagagctccggtcatatatccaagtcccagattatcgctcagaaaatccccgaaagctgttcccaggctattggaaaacagtattgctgtccagtaatacaattctttatttctctcagaaatcggatatacttcaagatttccgtattttttataccataaaaacagggaaagtaaaagcccggagagtaaaatgaggcttccggtaagatatcctgttttcagcgttctgtctataaaatctgagatttctgtccctaaagtcgttgttccgatgatcaccatccagtaaatcgccgggatatatttttttacgctgagctgcacagacaaaatgatgatgaaaaataccagggtgatcacaattcccgcaacatatcctaaattcagggtcatggaaataaaatctcccagtgtttctcctaacgtggtggctacaattttcattaaccagaaaaggagcgtaaccgctgcaactttattaaatgttctcattctcatgtacttttgtaatggataaaggatactgcagaattaaaagcatggaatgtttctgaatcatttctaaatacagttaatacctcagtatattttatacaaaggtgcagtccgatttagaagaaattttgaattgctgggttcggaaatctttttaactaaaatttaacggtgaaaatatggaggccgttttcaaatctgtagctgatcatccattggtgcagcctgcctatttcctgtatgatagacagtcctaagccacttccgttgttgtccgctgaaaatttagaaaatcttttgaacaatgcttctgtattcagtttttccgttcctgaattggaaacttcaaaataagattgatttaattctatagacacagaacctcccggtgaagtatggcggatagcattgatgatgagattgttgatcaatatttctgtcagaatactgttcccgtttacttgtacatcatttgaaatactttcagtggctgaaatatttttttgttcaaaatgctcttcgagaatttcaatactttgatgaagcagctgatcaaagaaaattgtttctgaatggtcaaactggttattgtcaattttcgcgagaagcaaaaggtttttattgatacgggaacttcttgtaagcgctttgttgatgtcttctgcaattctgtattgcttttcagtaagatcctgatcctgaagtaaaatgtccagtttgtttttaataatagcaagtggggtctgcagctcatgagatgcattttcagtgaattctttctgggccttataagtagagatatttcgctcaatgagtttgtagagagattgattaagttcttcaaattctgaagtatcagaaaccggaaattctatggtactctgactgttaagattaaaagtcttcaattgatctaatgtatccctgaatggtttccagatcgatgaggacagctttctgttcagatataaaagtccgacaacaataaccacaaaaaagaatatggtgatcatcgcaatcacagctatggtttcatgggattcttcaatattggtctgtatggtaaaaagataaggtttgttatgcagataaactacttttttaaggcatctgtaacgttcctttttttgttctgaaataaaaggcagctgcttttcgtaggtataaacagtgtctcttctgatctgaccgggagaaatcttttcaatattggtttcaggctggatttgattccataattcaagacttttttccaatgcttcatcagaaagctttaaacggttaaactcaaaagctgttttctctataataatctggttatgctcatccagctcatttttccagatcgtatccactacaaaataatacacaggaatactgatcatcagtacaatcaatacgtagataagaaagggtttggtggtttttgttaatagaggcttcacaatagttatgaattataaatttatagtgtttaaggtttaaagttcaggatttaaagtttaagtaatatacaaaagataatcatttttcaccttcaaccttcaactatcaattatcaattctcccacttataccctgttccatataccgttttgagataatgtccgcatcccgcatcatacagttttttcttaaggttttttacatgagcataaacaaaatcatgattgtcaagcatatctgccagatctccggaaaggtgttctgcaagtgtacttttggagatcactttatttttatttccgataaaataaatcaagagatcgaattcttttttcgttaatgaaatcgtttcattatttacggtcactgttttagccaacagatctatctgaagctcattttgtttcactacgttggagctgctgaactgtttccggcggatcacagaatatacccttgccatcagttcagaaagatgaaaaggtttggtaagatagtcatcggctcccagcttcaggccttcaattttatcatccaaagcgtttttggcagaaataataataacaccgtcctgtttctgctgtttctttaattcttccagaattttcagaccattgccgtcgggaagcatgatatccagcaaaatacagtcatagtcaaaagcctctgttttattcatggcttcatcaaatgtagcggcatgttcacagagataactttctccggacagatattcggaaatacttttcgcgagctcagcttcgtcttcaacaatcagaattttcatgcgataaagctatcattaaattttgaagaaattttgaatataatgcatctgttatataaatttctgattacgatctctcctaagagatgtatatgatattgtaaaataggattttatcagagacaaaatccttatttctacaatattttttacaactaaaaattctttttcttattgcgtttcctaacgctatctgattttctatccggttatttttctcccggaacctgggctttttcatagatcagcttttcactttttaattctttccaaaattcagcaggaatagcagtgttgagggcttccctattatcttttacctgttcaggcttgctggctcccgggataatggaagcaaattcatcagctgccaatacaaaatggagtgctgcatcaacaagacttatactgtacttttcagcaatggaagtcatccgttcccttttttcactcattcctttcgggatgacatctttataattgtaacgctcccttcctaccacatatcctgaattgtatcctgctcctgaaaccagttttacaccagcttttctgacagcaggaagaagacggtccaccgcatcttcatgttcgaggattgagtattgtgttgcagaaagacagatatccggatctgcagattcaatacagtctaagataggttctattttattgacacccattccccaggcttttataacaccctgatctctaagttcggaaagaatcttaaaagcaccttttctggcctgttccagaaaatagggataacggtcaccgacctggtcttcggataaatcatgaatataaacgatatcaatatggttcagcccggttcttttcaggctttcttcaatagacctctgtacagcatcagcagtataatcatggcggaaatcataattcaatggatttttccacatggtaggcggaacctcagcttctggtacttcacggaaaagccttcccactttggttgaaaaaacaaaatcatttctttcctgatctttcaggaaatctccaaatcttcgttcgctttttgttaatccgtaccatggcgaagtatcataatatctgatgcctgtattccatgccgtctgcagaatttcatgagcctgctcatctgtgatattttcgaaagccgttccgatcgctactccaccaattcccagtcggtgtttttctgttaaaatgtctgttttcatattgaaatattttatggtgttggttataaacaggctgcaaacatcgtgcagatatcatggaaacgttaaaagtaaagatcgtgttcaaccttttgaaatccttaatgagtaaagctataaggcttcttttgatattttaaatattatgttaaatgtttttttcatcgcttctttggtcttgttattgaataaactgtaatacaccatttcaataaattatttcatatgaaaaagcatattctaatcgtaggaggaggatttgcgggtattaaccttatcaaatctctcaaaaatgataaacggttcaaaataacgctggtcgataagaataactatcatttttttccacccctgatctatcaggtggccacttcttttatagaggcctccaatatcagctaccctttcagaaagctgttttcaaacaatagaaatgtgaaattccatatgggcagcctgattagggtaaatcctgaaaacaaaacaatagatacggataccggtactctgggttatgattatctggtattggcactgggaacagaatccaactttttcggaatggaaaatgtaaagaaatgtgccttgccaatgaaaaatatcgaagaagcactttacctgagaaatcatatcctgcttacccttgaagaagcagcccgtaataaagatatcaagcaagccgaaaagcttcagaacatcgttattgcaggtggcggccctacaggggttgaactggcaggaatgcttgcagagatgggaaggtatattgctcagaaagaatatccggaaattaagttaggcctttccaatctttatcttatagacgcactgcctacccttctttccccgatgagtaagctggctcagaagacagcttatgaaaaactgaaagaattaggtgttaaaattgtattgaatgtttctgtaaaggattataccgataacaaagtcatcttaagcgacggaaacattattgagacagaaacgctgatctggacttcgggagtgatcggaaaagaagtttctggattaccggaaaacagtatcggaaaaggaaggagaattctggtggatgcctataataaagtagagggaaccaatactatttatgcattaggagacatagcactgatgctttcagaagaaaaatatcctaagggacatcctcagctggctcaggttgccattcagcaaggtaaaaatcttgccgccaatttcaaacggatagaagatggaaaagtgctggagccgttccattacaatgataaaggaagtatggctatcatttcaaaatacaatgctgtagtggatcttccaaagcattcctttaatggctttattgcctggctcacctggctttttattcacattattcctcttgtagggttcaaaaacaaaattcagctggcagtggactggttccgtttatttatcaccaacaatccgtccatcaggcttattctttttccgaaaagaaatacaacaggcaacggataattacataacaaataccaacacttaaatcttatagtatgaaaaatcaaagaagacctcctttttttggagaaacagtggttattacaggagcatcaagcggagttggtaaagccacagcagaagcttttgcagaacagggtgcagatcttgttctggcagcaagaggtgaagacgcactcaaagatacagcagagttatgcagaaagctaggggctactgtgattgcagtacctacagatacttccgtagctgaagatgttcagaatcttgtcaaacaagcccttgaattcagtggcaaaattgattattgggtaaataatgcgggagttcttgcatttggtaaatttgaagagattccggcagatgttacagaccagattgttaaaacaaatctcctaggatatatgcacgcagctcatgcggtacttcctgtatttaaaaagcagaaaaagggagtactgcttaataatatttctattggcggatggatgccggcaccgtatggaacggcctatacagcctcaaaattcggggttcgcggtatggtggaaacattacagggggaggtttctgattttccggatattcatatctgtgcattgtatcccggttttcagaaatcttcaggaatagaacacgctgccaattattcaggaataaaactgagtacccctccaccctcttttgatccccggaaactggcttctgcaattgtaaagaccgctaaaaatccaaaagaagtcatctatccggactggtctgccattgtatttaaaaatttatacgaaatagttcccggaatcatccgttatgtttcttcagcaggaatgcgtatggtaatgaaaaatgctaataaggataataaaacgggaggaaatgttttgaagccctccgaaggtaatatgggaataaacggaaaaacaatgttttcctttcctaaaaaaactttgctgtgggcaggtgccggactcataggagcaatggctgcaggcttgcttttatcaggaaaatccaacaaaatagaatcatcataaacaggtaaaatctgataggataaaggttgaaaaacctgcttttggctgttttttgtaagatatttcataaatttacggagctgtatctgtttcatagcagcataaaaatgtttccaaggtgaaaattcacaacaaaaaaaagtacctgagcttccttaaatttaaaagagatttccagaaatacggattggaaaaagcacgcagttatgagcttattctgcattggctgaacaacagactgagcaggaaccagtttcttgtgctttccgggattcttgtaggctgtacggccggcctcgcaggggtgatactgaaaactctggtacacaatattcattattttattaccaataaagtacattttgaatatcagattttattctatatcgtttttccttttttagggattgtcctaactaccatgattgttctgacacttttcaaagggcaggaccgtaaaggaatcggagctattttgtatgagattgcacagaattccagcattgtggcttccgttaaaatgtattcccaggtgatacagagtgctgttaccgtgggattgggtggatctgcaggactggagagtcccattgccgtgaccggagctgctattggttcaaactatgcgcaaacctacagactgagttataaagaacgtactttactgctggcagccggtgctactgccgggattgcttcagcattcaatgcgcctattgcagggatcatgtttgcttttgaaattcttctaaccggagtagtttttacagactttattcctttggtagttgcagcagtgtgcggaagtcttttgtcaagaattttacttcaggaagatgtgcttttcagattttataccagagatgccttcaattataaaaatgttccttactatcttattttagggattgttacaggtttatatgcccgttattttgtggttatttctcaaaaagtggaacatttcataaagggacttcagctttcaagaatgcgtaaggcgatgtttggaggggctgttctttcgctgttatgcgttttgtttccaccattattcggggaaggatatgaaaccgtgaaagcctttaccaacgggaatacctactctattattgaaaacagttttttcagatattttgaaatcggtgactggacgattatcatatttttagttctggtcttgcttttaaaagcttttgcaacgtcttttaccatattcagtggtggaaacggagggaattttgctccgtcgctttttgccggcggaactttagggtatttgttcgcactggtatgccagcatctggggtttacagatgttcctgtgactaatcttgttctggttggaatggccggagcaatgagcggtgtactgtatgccccgcttactgcaatatttttgatcgcagaatccagtttcggatatgatttgtttatcccgctgatgattgtttccgtgatatcttaccttattgccaaatggttctccccgatttctcctgaactgaaatctttggcagatcagggaaaaatattcaccaataaacatgataaaaacctgctctttgctttaagaacggaggattttattgatcaatactctcagaccatcaatcagaatgcttctgttacggaactgtttgaaatggtaaagaacggagataaaaatattttcgctgttgtagatgacagcagaaagctgaaaggagtgcttaccctagacgatataagaccttatctctttaataaagaaatagaaacttcccaatcgatcactcagattatgaaagcaccaccggcagttcttcaccgtgaaaataagccactggatattctccagacttttgatgataccggtgtctggaatcttccggtagtgagtgaaaataatgattttataggatttatttcaaaatcttcaatactgatgagctacagacagcttctgaaagaatactctgattaaatattgacgtacaatatgacacctgaagaactcaattcccctcctctggcggggtggcgaaaattcaaagaatttttgacagggtggtcagcatggtcgaataacaaaaatccgttcaatagctgaacggatttctttttaatctataatgaaagtcgaaaaaattagttgcttgcgttattgagcagatcaatatcttcctgatccaaaacaagctttggggcattgaatactgtttccagctgtgatgcactcgtagcacttacaataggtgctgtgatcaatggattcgataacagccatgccagggaaacggttccttgtgtggtattatgcttggcacttacctggtccaaagcctttaaaacctcaagtcctttatcatttaaatattttcttaccccttcacctctcgcactttttgcaagatctgcttccgtacggtatttgcctgttaaaaagccagctgccagagaccaatatggaaacacacttaaatcaaactgctccgccaaaggggcatagttttgctcaaaaccttctctttccaccaggttataatgaggctgcaatgcaacatatttaggaagattatttttttctgccgcgtcaaatgatgctttcagacgttccggagacagattggaagctgcaatataccgtacttttcctgctttaataatctcatcatatgcggacagcgtttcttctaccggagtggtatcgtcatcaaaatgggtataatagagatcaatatgatccgtctgaagtctctgcagcgactcatcaacggattttaagatatgttttctgctgatatcaaagccatgttcttttgtttgtgaacctacttttgttgccaaaacaatatcattacggttgttacggcttttcatccattttccgataatttcttcagactgtccgcctttcccgttcacccaccatgaataagtatctgctgtatctataaagttgaatcctgcttctgtaaaacggtccagtatatcaaatgactgtttctcatccagcgtccatccaaaaacatttcctccgaaattgattggtgcaatcgttaaatcggtatttttgatttttcttttttccataaaaataattttactaagtgacctctaaggtaggaaatattaagcctgaaggatatttaaaatagccattttccctatagttattatgaatgaaaatgctgatgtttactaagtttttttgcctattatctgttggagaacgcaaagacgcaaaaccttactcgtaatgatgctataaggcgcaaggattttatcgcagatgaaattgcatacctttaaatggagtatacttgctgaaaatcaaagattttcatacgtcttaaatgaatgatcatttcataaatctttgcctctctgcgtttccaataaaatatagttatttttcaatctgtggaatctcaatggccataagctgaagttgatattcttgtagctggtgattgataacagataatccgtttctgaagtatgaagaatttttaaaaagctcctgataatattctatcccttcgagtacattttttctgaaagtattccactttttggtttgcgaatgggtgatctgtactggtgaatctgtaatgtcctttctcagataatcaacgtacattttcagttcgctaataaacatattcggacgttggttattggaaagaatattcttatttccgtaaatatgttttaccatatctgaaagggaaacctccttgtcaaaaaaggcaatattgggtccgggacatatcacaacgccttgtttttcacctttgatttcaagattttgttccatataagcggcgtttaccaagcctacacagagacacgccttatcggtgattgcagcctttcttttttcaaattctgcctctgtcagtgtttctttttcagcataaagttcttttagtttgatatcctgatattttctggaggctgtacaggttccttccggagaaaattctttactcaaagcgagcagctttttaggacatgagcttccgtatttaccttttgcttctttttcgtatttcagtttttcattggaagttccttttaccgtgttgaaagggactcccaatggagaaatattgctcagatagaaatcctgttcttttgattgtacaagcagattacgggtttcagcatctacagaagtagcttcaggtaccagtaaaaaaggtgatccccaacctacgctgtctacattataattcgccaataaaaactcgtgttcttctgcggttcctactccaccctgaaccgtaattttcatttctaaaggcccagatattacaggcttccctttttgttctaaagcagtgatcattaaggaatgggcagattgtatcagatcattttttttctgcttgaattcttccataatcggtccgagaagcattccttcggtagcaaaggcatggcctccgcaattcaatccggattctatcctgtattctgaaacccacaatccttttttggccaggaaatttccctggatcatggcagaacggaagtcacttactttaaggatgattttctttttgatctttccgttttcatccggaaaaaaatcttcaaattcttccatatagctgtatagacggggattcattccagcagaaagtacgaccgatgatgaaagcttgcttttggcaaatccccgaagtgaagcgtgagcgtcgttatacatgaccggaagctgttcattctgatgataattatccttatctactttcgtcatgatattgacgtcaatacttccgggatttaaattggattcaatgaaacttttaatctgggaactccagttgtctttctgatggataaggctttgaaggctgtttttgaggtctgaagtattgggaagcatagccataaagtctttcaaagcctctttatttctgctgatttcctgtttgaaagattcaaatttttcattcacgatatcatctaccatatccagataggctgtaattcttctggctctgtaatcctcagtttttgtagagataccgaaataatcaagattgaactttttattgtaaaagttcttcatcttctcaaggatttcatcatcaatgatggagatcacagaagatattccatactgcgcaacacgaatcgggctgtctatcgtataagccagtcccattaccggaatatggaaattgtgcaaaggtttttttgtcataaagttttgataaaaattctttttatttatctaaaaatcctttacaactattcactgccataaaaatattattttaaaatgaattatgcgttaaataacattttgtaatataagaaacatgtcaaatgtcattttttaagagaataaagaactgcgactttgtcactgaaattttataaaacaaaaagaccaatctttcgattgatcttttgttaatggtataatattatttaaagctattccgctttgtttttaagcatcatcagaaggctgtaagctcctttctgtacaattttcttatcctttaaaacatcagcttttaagatttccgtaaactgatcatctgaaattccgaccgctacaggaatcattttataaccggattttccaaggtcttcaaaaacataatttttgttttcaaaagaaaccacggcctcgttaggaagtcccgttgtgtagcggctgctgatgtttacttcggcattcacgtacattccttttacaaattcagtatttacagatgataatctggctactgcagttgcagaacctccgttttcaatgcttggaacaactctgataatcttagcacttgatttcacatccggtttctgattgttgtagaccagaatttcctgcccgactttcacatcatttacatcattttcaaaaacctttaattccaacaataatccggatggattaatcagctcaaataaagtatctgccggattgatatattgtccgttactgacaaggattttgcttacaaaaccagtaaacggagcgtagatatcaatcttacttctgatatttcccgtacttagtcctttggcattaattccaataattctgagcttttcctcgaggccttttaacgtagcattcagagtggaatattctgcctgagcggtttgcatggtcttatcgctgctggctttgctggtattcagatctttctgacggttgaagttcagtcttgcggcttccagttgggcttttgtcaccagataatcctgctgcagctgtataaattgcggatcttctactacagcaagtacctgtcctttgctgaaatggcttccgttaatcacattaatagacttgatgtgtccgcccatgatgctggaaaccagactgatgtgagacggcgcaatttctgctttcccgttcagtttcataagcttttccatatttctgtcctgaactgtggtggttgtcaatcctacagactgaatctgtttttcagtcagatgaactgtattttcattgttcctggtaaattttgtgttttcgtaaaccgttttttcttcctctttctttgaacatgaagttacagtgagaattagagcaaggatgtatagagatatattcttgaaatgcatgacgtcgttattttgaaattaagaattgaagttctgctcctgtctgattgagcttttccagctggtcaatataatctgctttggtttttacggcctggttcacgaggattacccaatccagataatcaatttcccccacttccatctgtttttgtgctgtttttaaaattgtttcagattttggaagctgtttttgttcatagttttcaatgatccgctgttgattcatataattagccagctgctggtttaacctatttttaagttcaatttcttttctttggtactgattttcggagatggcaatttttgcctgtgctgcttttgccaaagctctttgtccttttgtaaataagggaattcctacacccacctgtaccgagttgaaacggttattattaatgtttttcatactctgattggtatatcccaccaggagatccggaagcagtctgcttttttccagctgtacttctgcttctcctactttgatctgttgctgcagatattgaagttcaggatgctgctttaccatttcttcagagatctgaagacccaaattgatcgttggttggtcagctatgggttggtaaggaacctctgactgaagtaatagctgaagctgaagttttgcgatgctcaggtcattttcaagagtattcagctgaacttttacctgctctttttgaatttctgctgtggattcctccagaatgttggcttcccctttttttaatcttaatccggctttctcagcaaaattattgtacagctggctgatgtattccagcacttttttcttttcctgaaggaccaatattctatagaaaatatctgtcacttctttggttagctgtgtctttgtcagattctgactgataatactggcagaccattcggcatccagcatctgcttcctttttgaatatactgtcggaaagctgaatcgctgagaaattccgaatgaattatcggtttcctcaccctgaatctgcccaaaccctccggtaacttccatctggggaatattcaggtagctggctttcagtttttcctgataatcggatactaattttgaatttttaagagtaccattttgctggtatgctttttccagagcctggtcataagtaatattttcctgagcctgatagcttccaaaggagatcatcagtacgaaaacagacagttttttatagttgggttttttagagaatttcattttatctttattaatatgttcaaaaaggacgtacagaataggaagtacaaacaaggttaaaagggttgccagcattaaaccgccgattactacagttgccaaaggtctctgtacttccgctcctgcgccattgctgatggccataggaaggaaccctaaagaagctacaaaagctgtcattaaaaccgggcgaagcctgatttttgttcctatcagtacaattctgctggtattggttattccgttctttttcaatcggttaaactctgatatcaaaacgattccattaagtactgcaacaccgaataatgctataaaccctacgcctgcactgatactgaatggcatccctctcaacgccagaaaataaacccctccaatagcagataaaggaatggcagtgtagatcagcaagctgtgttttacagaaccgaaagcaaagaataacaataggaaaatcattactaatgaaattggaacggcaactccaagtctggctttagcttcattcagattttcaaaagcaccgccgtacgaaaccgtatatcccggtgagagtttaaggcttttaccggctttttgctgaagttcttccacaatactctgaacatctcttcctcttacgttgaaacctacaatgattctccttttcgtatcttccctctggatctggttcggactgtttttaagctctactttagccagctgtgacaacggaatctgttctcccgaagtggtaggaaccagaagattttgaatgcttgtaatatcttttttatgttcattatccatccggacaacgatgtcaaatttcttttcaccttcatataaggcgcctgcggtctgacctgcaaaagccatgttgatcaccctgttgatatctgctactgaaatattataacgggacagttcagaacgattataatcaataaccacctgcggagcacctaccacaggctcaatataaagatcctgggcaccttttacggtattgatgatgcttcccatcttttttgcatatgaagcaaggctgtccaggtcttcaccataaattttgcaaaccacatcctgtcttgctcccgtcatcagctcattgaaacgcatttgtacaggaaactggaagctggttgtcaatcccggaataacgcttaatgccttactcattttatcggaaagctcctgaaatgttttggcagatgtccattcttttttaggctttaaaacaatgataatatcccctgcatccataggcatgggttctgtaggaatttcagcactaccgattttggtcactactttttctacttcgggaaactgcgttaaaagaatatgcccggcctgcgtagttgctttttttgtttcgttgatgttgcttccttggaggattctcatttcaacggcaaagtcaccttcttccaaagacggaataaactctcctcccattctggaaagggtaaaaacagcacctgcaaaaaggatcaacacactcaggattattgtttttctgtatttaagagctttcatcaggagcttctggtgccctgtttccactttatccatgacacggtctgagatgttttctttttctttcttttttctgcttaataccagagaactcatcatcggaatataggtcagagaaagaataaatgcaccgatcagcgcaaaagcaaccgtctgtgccataggcttgaacatctttccttcaatcccctgaagtgtaaaaatcgggagatatacaattaaaataatgatctgtccgaaaacagcactgttaaccatcttggtagccgagcccgaaacctgatcatccatttcccttttgctgagcatattgtctttcccaaagtgttttttatgggcgagctggtgcagtaccgcttctacgatgataacggctccgtctacaataagtccgaaatcaagggcaccaaggctcatcaggttccctcctataccaaagatattcatcatgatgatggcaaaaagcatagctaaaggaattacagaagcaaccagtaatcctgctctgaagtttcctaaaaataaaacaagaatgaaaacgacaatcagcgcaccttccatcaggtttgtttttactgtgctgatcgtattgtttaccattttagcacggtcaaggaaaggttcaattacgactccttccggtagtgattcctgaatcttttccagtctttctttaatattcccgatcacgacattggcattctctcctttcagcatcaggacgatagctccggagacttctcctgtgtcattataagtcatagcgccataccttgtcgcataaccgatctttacggaggctacatctttgatatgcactggaatgccttcctgggtttctgctacctgaatttttccgatatcttcagtgcttcccaaaagcccttcactccggataaacaaaacagtttccttcttttcgatataagcgcctcccgtattctgattgtttttctccagcgcagcaaaaacatcattgatattgatattaaatgcctgaagctgattgggattaatggcaatttcgtattgtttcagctttcctccgaaactgctgacatccgccactccttttgttcccagcagctgtcttctaactacccagtcctggattgtcctaagttccgtttcatcatatacattttcatagccttttttggctcttaccacatactggaaaatttcccccaatcctgttgaaatgggtcctaattccggcttgccaattccggctggtatattgtcctgtacgagctgtaaacgttcctgaacctgctgacgtgcccaatacacatcggtattatcatcaaaaactacagtcactaatgaaagtccgaaacgtgaaaagcttcttaattctgtaattccactgatgttgctggtagcctgttcaataggaaacgtaacaagccgttctatatctgccgcaccgtaagaaggcgccgttgtaatgatctgaacctgattattggtgatatccggctgagcatctatgggaagtttagtggtttcatagactccaaaaagtacaagtcccactgtaaacagagcaatgatgagtttattctttacagaaaactcaataattttatttaacatgaaaaaactattaatggataacccggcagcaaaacgtttctgaatggagtctttatttattcacagacagcgactgaaagccttctggctttatcagcatatcttagaaaataaagtcagtaatacatcataaacaacgttatcatgcacaacaggttaaattgatatgtaataataattggactgctttaagactaaagcagtttcagtatagaactaattaagaaagccgcggaggctggaaaatctgagaaaggtactgatgggaaaaatctttttccttgtagatactggttttctttgaaaccgtaatttctttaggtttttttatttcgaatgtcagttccggaagctgggcatgtacagtcagtacaataggtggattgataaaaggcagtttctgatctgtatcccagtcagaatcctgtttgtggttatcataatgctccattacaaattctgaaagacttccctggtattccatgaagtgttcaacaaacataggcaccttcagtacttcccccgcattggtggtagccagtacatacatcatcgaacataatatggaaaaccattttaacatcagtgcaaatatagggcttaaatttttcctgaaaaggctctagtattaaatttttgagaattttctccggtttaaaaatggtttaaataaataagaaataatgttagatttaccaaacaaacattaaagtcttgatttcagcctgcttaaagtttcctgcgaaatattaagataggaagccaccattttattagaaagccggcgtacaataatcgggttttcttccagtaattgtttgtacttttcaagagcatcctgcaccataaaagacatcagccttttggtgttggcaatgcaggcaatttcaatataaattctgtaaaatttttcccactggggaataatgtccaataaatgataaaaatcctgatgggtaatataatagacttccgaatcttctacagcctggagaagttcatcagaaggttccgaagtaataaaggtatgaagtgctgtggcaaactgattttcaaaagcaaaatatcttgtagaatcctgtccctccttattaatataaaatatccgtaaacagccttttacaacaaagaatgttttcttaggagcgtgaacattggtaacgagaagctcgttcttttttaatttgacaggtttgaaataagaaagaataactttcaactcttcatctgttattgatattttgcttttaatatatgaaactaatacgtcttccatttatttaaatcagtcacagcaaatttagcaataaatatgttaaaaaacttactgctattacagcttcttaagtgctttcagatgattttccttctgcttgcccagctctccaataggaagaggcatacatcgcatgagtgtcccatttcaggtttgttttaaaatgggtgcgaagctcctgcactgttgtatattctgctgcgatatacacatattctttcagggctccggatggaaaccgaacagatttaactttttctgaaagctgacttccgttttcaggatgaggattgtgaagccactccaccgtaatatctgcggcagaacacagaataagctcatcttccctgcctgcaacttccaatatgatttttgctgttacgtaagaaggaagctgctctgctatggcacagatgaccggtaatgctgtagcatccccggccatgagataaaaatcagcatcgggaactaaaggtcttgtactttctttcatccctatttccagtatatcacccggattggctttcagtgcccaggcagaagccggtccgttatcaccatgcgctacaaaatctataatcagttcgagattttccagatcaatctttctgttggtatatgttctgataaagggagcatttccctcttcagccggtataaatattttgttatttgaaccggagcgtacattaaccaataattcagcctgattatcatttattttaaataccacacggataagatgaggcgtaagatattgtttgtttttaacgataaatgcagagcgtattttctttgttttgtcttcctgagcaattacagaattttccattcttattttttattaattaatagaattacgatagacactatacagctgatgcctccgaaaaggtacaccgtctggtaatcaaaccagcctgcgattaaccctgcaataggtcctgccagtcctaatgaaaggtcgacgaaagccacatatgctcccaatgctgttcctctcatctgaggttttactttttgtatggcaagaactccgagcgcaggaaaaaccaatgaaaatccaacacctgttaatccacatccggtaatggccaatgttttggatgcagcggtccagatcagcagctgtcctgccacttcaatgatcagagaaagtaaagcaatcgtaaaacctccgtatttatccggaaaggaagcaaataaaattctggtcagcacatagcatgccccgaagaccataaaggcaagtgaagcatcaccccagtttttctgtgagaaaaataaagcaataaaagaagcaatacatccaaaagccattgatgaaaaagcaagactaagtccctgtccggatatggcaccgattaccttgtagaaaggggttcgtatatgttctttatctacaggaatagagggaagattggcggtggaaagccagcttatcaccggaagtaaggcaataaggacaaaagcaggcaggatatcatattctttgcttaacaagatgctgataggcgctccgattgcaattcctgcatacatggcaataccattccacgtcattacttttcctgagctggaatgtcccacaagtcctattccccaggttaatgctcctgtaaccaggaaactttcacctaccccatgaataattcttgccagtaaaagaaagacaagtgccagcagcggatgagcctgaaataataccgccagtacataaataattccggcaatgacagccagtattacacccgacattttacttttcttagcgccttttgtatcggtgattttgccggaataggcccgggttaagagtgttgacagagactgaaggccaatgacaagtcccaccattatactgtcaaaacctaagctgctctgaacaaacctgggaagcacccccaaagcaattcctatcgtcaggtaaactccgaataccgaaataataatcggagcggttgcctggtagaaattaatagtctgtcccttttctaatgttgtactcataaattttgtttaaaatattcgggtgcaaaggtccccgaacagataacacaaaactttgatctagatcaaaaaaggtacagaggtttttaatcaaaatctaaaaaactatcagttagttgtttccattgtattttggcaactccgaacattccgggaatggcaatgaaaagatttcttattacatcaaagaatttcgcattaaaattaggcttttcattccgtccgtatactgctgctttcagatgatcaggactcctggatatcatgaaggtagaagtagctgtggaaccataaaaatgggcaatatgacggttttttttatcctgaggatttatggaaggcctgcaggtcatggatatactttcagaaaagctgtcctggtagaaacaaatatctgtaacttctacccagtcatatcctttggcgtcaggttctcccggccccggaatgtcaatccggataaaatcacctttctgaggctcccggttaaccgcattaccatcggaatcgtataatttaaatgctgcaaacgctttaccgctataactttcccattgattcactgagaaaaatctttcttttaatatggtaaatttcagcggaatcaaatcctgcctgtatacttttctgctttccgtatcatggaaacctccggacttttgtgcaggaacgcctttgaatatctttggactcatgtgataaggtttttaagcaatttaatgcaaaaactatccggaattttatgagcagggtcacaaaaaaggtaaacatttgtttgattattggcttacataagcggtttttcaggtaacaatctcattcaattatttcttattctttatagaaaaccggcctacaattcatataacggcgaattacattttactggatatgtttttatagtattaattcaggaatcttaaagaaattaaaaaagaattaaggaataattattttcatataaaataaataatttttaaaaaaaatgcacttacaatgttttgcataatataatttttacttatatttgtgaatcgaaataattttttttcatcatttgtgtttttttaaggtctccattcgtggagacctttttattttcaattgcatcataattgaatattatctattgaagtggaaaaataattggaatgtgaaatatttctttttttaatacaggtaatttcttttaaataaaggaatgcgtgaagttttgcaatgttaataattccctttttactgaatattgatgcttttataaaataggaactattgaatggtcttaataaaatctgttggcctgaactgcatcacggcctgaaaacttctggtgaatgcctgaacactcttataccctacttcataggctgtttctgaaattgtaagcgttcccgaacttaacaattccagacttttaatgatacgaagcatctgctggtatttgcttaaagtaagtcctgtttcttttttgaaaattcgttccagggtacgaaaggaaagaaaagcggcatcactgagatcttccatcttgatttcattccggtaatggctgtgaagatgttctatgactttggtaaggcgcttgtctttcggaagactaatgtgaagggtcagcgaatgttttacaaactgagggagttcattaaacaatgctttcagaaaaagggtttcattatgatctgaaatcatcagctttgaccatttctcggaatatttaatcatttcttttaaaaccggaggaacggaaaatacactgatctcatgataaaaaggattgtccgtactgatatctgcaaacattatcatcagcttaattttttcagaatgggaattcgttttgtgaacagcattcgggggaatccatacagcgtgattctgcggaagaagataaattttttcttcaatagtgatatactggaagccgctttccacatagaccagctgtcctttctgatggtgatgaaaaacatcatcatgaacccagttttcttcaaaccagacgaaataaggcttcttcagctcatcaatttttatactgtcgttggttttcatgtcgtttcaggttaaaactttggcaaaattaaacaaaattactaagttaattttgcacaaaagttttaattatgatgaagaatgaagtaaaaaagaatgcttcgtatgttttattgatcattaatgttctggtagttatattgatttccagcaatctccgctccccaattgtggcagttgcgcctgtgttgggagaagtaagagatgccttgcatctggacaattttcaggtgagtttactgacttctattccactgtttatgtttgctgcctgttctgtacttgtcagtagattttccaataaattcggaatcagtaaactgctgatgtattctctgattattttaagctttggtttatttttaagaataagcggatctctttggcttttacttttaggttctctattcattggcttgggaatatgcattggaaatgtagttactcccggatatgttaaaaacaatttcccgaagcagattggtctcatgacaggtatttttgctgtatcgatgaatcttacagcagctctggcttcaggatttagtgtgaaaatcggagaatggacaggattcggatggaaaggttccctgggaatatggctggtgattgcggcattgggttttatggttttatcattggaattcatattcaataaaagaaatcctgatcagcccaaaacggcgctcagcacatcagattttaatatgttcagatctgctcaggcttggaatatcagtatttttatgggactgcagtctttattttattactgtctggtagcctggctgccttcatttcttgctgattttcatatgcagggcgaaagttcaggctgggtgttttttgtgattcagattacgatgattcctgttacgttctgttgtccgattattgccagtaaaatgaaagaccagagagctatgatcctttttatatgtactctgatgttcggaagtacgatgatgtttgtcttcctgaagtctcaatggatttacgtaaatgccgtgatcatagggatttccaatggattgtctttcagtttatccattctgttcttttctacgagaacgaaaagcagcaccaatgcggttaaaatatcagggatggcacagtcggtaggatatctgattgctgcttttgggcctccattatttggcaagcttcatgactgggatatttcctggaatagttcgttttatttattgagttcggcagtattgttaatgctctattttgggatgaaggctgcgagaaataaatatgtagaagattaagacataagtttaaaggatagaaattaattaatcattgccttctatcctttatttttttgcttctttaaacagttttattaattaaaattttaattcagcttcttcaccgtcatcaagtacaaaacatctcttctctagtctgttttcattgattttctctttaataaattttctgttttccctgcaatgacttaaagtttccagatgcgttacccaaacagtagactgcggcgcatattcacagacttttaagatatcttcactggtcataataataggatctcctatggaaaaagtagcggcgcctcctgctacaatgatgtgttgtggctggtgcttatcaatttcctgagcaatttcatcgtaccaaatagtatctcctgcgatgtatactgatttattgtctgttttaaatacaaaaccattcacgattcccattttttctccgatttctccggttccatgctgtcctttggtggttgatatctcaatatttttgaattgaaccggatcattacttacagcaataatgtttgtgaatccttgttctgcaatctgttttgaaataacatccgggcagataaccggaatatttttatcaagaagttcaatagcagcagcgtcccaatgatcaggatgaagatgggttacggcaaccgcatctacgctttctaattttttaattaattcttctttattaaaaggcaggtttaccagagggttcagtaattcgctctctgtcattggcatttttcctctggagcctttatctccgagcatggaatctacaaggatggaaactccatcaatattcagtagcaatgttgcattgcgccataattgtaatttcattttgggtatttttgttgaacaaaggtattacctgatcacggtaaaacaatcgaaggttaccaaaaggttaactataaatattcaattgacttatgaattttgaagaatttaaaaactgtggattaagacgaagcctggatgtcctttcgggtaaatggaaaccgctgattctgcaaaacctctttgaggaagatcaggtacgttttgtagagctttggcggaatatgcccagagtttccaagaaagtactggcagaacagttaaaacagctggaaaaagatcttattattgaacgaacagaagtgtataattttccaccggaagtttattataaactgacagaaaaaggtcaaaagctggggcctattctttctgaacttcattcatggggagacggattgggataaagctgtttattgcattgttaacttatatgtgatctgaaactaaacggtattccgtcagaagaaatgacaagatactgaatgagtttctttatagtaaagctttgtttttttgataaaaaaaatcgcgataagtaatacttaccgcgaaataatataaagatttagaaaataaaatcacatgtattgatgtctttgtgatggttagttcattcctataaatttgaatttgaacagttgacatgaggtgccataataatcccaaagctgtaagttagaattaccgtccatcgtacagttctgaatatcccagccacgggtagcatcaacttttgacaggattttgtaataaccattggagacagccactacctgccacgcctgcgcatcattgccatagttctgccaaagcctgattgatgtccccaatgtattgctgttacttgtcaggtcaatacaacggttagatgcactcgctttggatacaaaacgccagtaaccatttcccgcatcaatagcaacccatcgctgtgcgttggcaccatttcttgtccatggtcttagcactgcgccgttggcatcctcacctgactttaaatcaagtactttgttcgcatcggtctgaaattcaatctcataaatgccattattgaccaaactgctggttgtgttacagtttccaacaggataattggaagatgcatattgctgaaaccactgtttgcttggggcggcacacgcctcccagtcgttattgaaggctgttccggcattaggatctcctttgtgaagcagatcatcaggggcaaggaggttccagctcacattgcccgactgatccacaatatattttaagtttgcgccaaatccgcttccacctgcagtaccggttgtagcaacaccgaaggtaccatatccctgaggtgcccagtcggtttctgtaatggcgatcggtgcaatgtcagcgattggtttaacattgatattccatgcattttgaaaggattgatagttgttgacaccaccccagtaacccggataaatgtgaacagcatagccaatatttcctcctgtgatctgattattgacataaccctgataatgcgattgccatcctgtacccggtatccagcaaacattattggctccgttgttacggataatattcactaaaggctggaagaagtttttgagcgctgcaaagtgctcgtttcctgtagatccccatgtgccgtttgttccaaggatctcaacaggctcattggctaattcgaacatcacgttgtcagcattctttaagcccggatgctgtgacaaaaaggtccacacagttttaagatagctgtgatacgcatcattcacggcaatacggttcgggcatacacccggtggacgcaggataacatacatccccaggctgcgggcatggttgatcaatggaataatcacctgatctgtatacgtaaccaggcggttataattgaatcttgagatatcgttctctgggatagccggtccgggatcattggtccaatacggatcaatgtgaaggcggatgtagttgagataccagccatcagcagcattactgagcttggtcatgacagctttgttatagttcagagctccctggacattgtaattgtcccaggtacaataacctgaattggcaccgtactgacatccgttaaaccacgggctgggtgttatggcaacaccatgtaaaagaacattattgccacacggatcctggaggtatctgcctcccacatgcagcatgggtgtggccgcgaatgctcttgcagtagcacttagattagcttcagtttcttcgagtaaatttttttcatccatcgtagaacagctggaaagaatgattaacagaaaggccagtagccacattttgtttgttttcatagtttaaatattaatattaaaggtgatttctcagttttacttttagccatcaattttccgactcgctattttacgtaggagtttcagatgtttggatagtaaagtaatgttgcaataatgtaactctgctcaacagaattatgagttggtcttcgttactttgttttgctttcagattcagcagaaaaatggaaccgtttctattccgtttcagactgaaagactttcttctttttccggattttccacatgtataggtgtgatattatgaaaatccaaattatcgttgattacgattgttagtttatgataaaaataatcatattattaaatataaagcaattttttaatgaaatttatagcaaaaaatcaatatcataaataaaataattaacaaatggtcataatgtttttataataaagaaaataaaaagaaccttatcataaattttcgtttagatacttatgagaaaaagaagaaagtgattgtttttatactgaaattttccattttaagctcaaaaagttctcacaaaaaacgggatttattgatgctgaatattaaagttgtaacaaaaatatattttaaacagaatttggatttcaataaaggtgacaggaagacttatagtagatttaatatgtcaataactcttgtcctttaatacattaaaaccttataggtttgaaaacctataaggtacatttaaaaaaattaaaaataattattaccggaaggtaccgcttattgtttaaactgatccagaacttccgtaatattctgatagacaaattccaattcttcggaggtaatacaatatgggggaaccagataaatgacgtttcccaacggcctcataataatccctctctgtaagaattcattgtaaagcttcttccctatttcattgaaataggaagtcctattcccggttttgaaatcgaacgctaaaatagtcccgatctgtctaaccttttctgcacaaggatgtaaagcaagtgctttcacaaactctgaatgttgatgagtgatgcggttgatattcatttgagtttcatttgtaagtagcaattccatactggcaagagccgctgtgcaggctaaaggattggctgtaaacgaatgcccgtgaaataaggttttataacggtcttcagaaagaaatgcctcatagatgtcattagaacaggtagtgattcccataggcatcgttccgccggtaagcccttttgaaaagcacatgatatccggtttttctgtaagataatctgctgcgaaaagttttcctgtccttccgaatcctgtaaaaacttcatcctgaatcatcagaataccttcttctctgcagaatttcatcatctggctgagatcttcagctttatacatcaacattccggctgccccttgaaccaatggttcataaataaaacatgctacttcatcggccaactctttaatttgtgatcgaagactttcaagattttcagcattgggtgtatccataaaaacaacttcaaacagcatgctttcaaaaggtcttgtccagaaactttttccgcttacagacatggctccgaaggtatctccgtgataagcatttttaaaagctaaaatctttgttttcttttgtcctttattatatgcatattgaatacacattttcaaggctacttctaccgctgtagatccgttatcagaataaaaaactttttcctgaccggatggaagaagcttcagtaagttttctgaaagcttcactgccggttcatgagtaaagcctgcaaaaataacctgctccagtgtatttaactgttcaaatacacgttgggcaatataaggatgcgaatgcccatgcagtgttacccaccaggatgaaacaatatccatgtatttatttccttcgttatcataaagataaatccctttcccttttacaataggaatggcatcttcagccgttttcatctgagtataagggtgccagttgaccgctttatctctctcttgcaggctgatttcttttgttattgtattcatatattgattgtaatgagtaatggagatggatttaacaataatttagttgaatatgtggtcgtaaatgttggattaatcgcaaagacgcaaatttatgatcgattactattattttaaggacgcaagaaaatcaaagattttcagcaagtacaacgcttgttagtcattgagacgtatcatttgtacataatcaattttatcgtagataaaatccttgcgtcttaaagtattatttactacagaagcttttgcgcctttgcgttttccaacttgtatagcattttataaaaattctaaaaccaagtttgcaataaaagcgataatactaatgatccaactcatcactcatcatttataattcataattatctaacagcatgtttcttttttcatcataggtttcagtcctaaggtctgcagcatttgcatatcttcagatacgccgggattaggcgttaccagtagtgtttctctttctcctgtgaaaatggaattggctccagccataaagcaccatgcctgttctgtttctgacatttctatacgcccggcacttagtcttaccatagaagatggcattacgattcttgcagtagcaatcattcttaccatttcccaggtatctactttttcattgtcagccaatggtgttccttctactctggctaaagcattaatgggaacagattccgggtgttttggcattgttgccaacgttaaaagcattgaaattctgtctctgtgagtctccccaagcccgataattcctccggagcatactgtgattcctgcttttcttacattgttgatcgtattgattctgttgtcaaaagttctggtagagatgatctcctcataatactgctcagaagtatcaaggttgtgattgtaagcgtacaatccggcttcctgaagtcttaccgcctgttcttccgtaagcatccctaacgtacagcagacttcaagaccaaggtcatttactcctttcaccatgtcaattactctgtcaaaatcacggttattacgaacttcacgccatgctgccgccatacagaatctggaagatccggaatcttttgctttttgtgcatgggcaattacggtttctgtgggcagtaaagcctgtactttgatattggtgtgataacgtgctgcctgtccacagtaggaacagtcttcggggcatccgccggttttgatagataataatgtggaaatctgcacttcagaaggatcatgccattcgcggtgtacggtggctgctttatagatcagttccatcagaggtaaatggtaaatttcctcaatttcttctttagtccagttgtttctcaatgttgtttttgtatccattatcctatttttgttattgttaattgctttgcagcaaggtgtatagattccttatctgtattcatgatttccggaatctttataatttttgtttctttttcgataaaactacagatcactctttctgtatcttccgggaaatttccgttaagaattagatactccaacggtatttctctctgtcgtaaagctaagattgagagtaaactgtgattgatgcagccaagatagttccttacaaccaatgctgccggaaggcttaattcctcaatcagatcgatcataaaggtcgtgtctgaaatgggtaccataagacctccggctccttctacaatcagtgggttggctgttttggggagttgaaaatcattcagactgatggtgatattttcttctcttgccgattgatgtggtgatgcagccagctgtaaccggtaagtttccggatggcagacgttcgtatctgtccatgcttcaattttatgactgtctgtataatgcagatctccggactgtatgggtttccagtattctgttttaaaatgctgtaccaaaacggctgagcagactgtttttcctatttcggttcctattcctgttataaataatttcatgtttttcgtgatgcggggttcgggattcgtgatccgggtgttgaaagttttaaataaattctttaataattcctgtcagttttataatttcttcttcagtgttaaagctgtgaagacatattcttaagcgttcgcttccttcttttactgtggggctgtagatggcataggttaaaaatccttcttcagataaagtgttctgtaatgctttcagtctttgattgtccgggatcacaatagcctgaacaggacttgtttctgcggatggagactgtaaatttctgcttcggaaaactttgacattattcttaagcttttcagccagttcatggttttgatctaaaaattcatatccggttttgatactcatccactggaaatcctgtgctgacgtggtataaatgaaaggacttgcaaaattgatcaggtaagatttcactgtttcattgcaaagaatggcagctccgtggcttccaagagcttttccgtaagtgataaccgctgctggaacctgattctgtaattggaatttttcaatcaagccatatccaaaaactccgaatgcatgggcttcatctacaattaaagaggctttatatttactggcgattgaagtgatttcctgaagaagagcaaaatctccttccatagagtaaaggctttctatggcgatataacaatgaccttcctgtcttcttaaaatattttcaagatcttcagtatcattatgcttaaacttcagttttttagcattcgaaagcttacacgcatcatgtaccgaccgatgaatctgttcatccacaattactgtatcatgacggctgggaagcgttgaaaacaaagcaaggttggcattatatcctgacggaaaaagcaatgccgattcaaaatgatgtttccgagcaatctcattttccacggaaactgcaatatcactgtttccgctaattaaccttgaacctgtgcttcctgaaagcagttgaggattttccataattttctccagcaggatgttttgaagctgtttgtttcgagcaaatcccagataatcattggaataaaaatcaattccgtcagaacgaagtcttaaatgtcttaatgttccttcctcttttcgtttgtcaagggattccttaaaacgggaagtattgctaggcataatgtaattgggctacttcttctgtaatcgcattaatccaatctttatgcagttctttttctatggtcagaatatggtctgcatgatgcttccagtctggcgaaaattcattcagctgatgaatcatttcttccagatgtccttcttcttcaaggataatagattttaccataattttagaagatgcttcggtaagtgcttgttgataaaccggataaagttcatctgcccgaacttcgatcgcgtaggttacaaaaagataagcagcatatttaatatctgttttattaagttggaaagcttcctgaagataacggcaggctttaatatctaatgagtgaagatattggcttgttgctataggagccagaagttctgtgctttcataggttttgcataactcggggtttattttcccaatctgcttttttaaataataagcgtggcggtgttcttcagcagcatgtttcagctgaatctgggaaaccaatgtcgggtgttcacattttgatatttttctggcaccggcattttccataaatgaaagcgtgttcagccatttggcgtgggtgtttccgtcctgtacaattcttcttaacagatgatgaaattccatagatttttattttgatgtcaaaagtagtatattgccggatggttgcatggtgccagttttgatattatggatagtccggtcagaattccctatgaaagttttataaagattgatagaaaatctgagacttctatctatctacagattgcgaatcaattgatcaatgccattcagcgtggtgttttaccttttggaacgaaacttccgggaacaagaagcttcagcgagatgctggaaatccacagaaatacagcagttgcagtgtatgatgaactttctgcgcagggctggacagagagttttccgaataaaggaacttttgtgattggaaaagatcaggaaaaacctgttaaattgaatgattttaaacaaaataatcttcaaaactaccctgtttcaactggtttttcgtttaaaacatccaacattctggataatccttttgaacattcggattgtgaatatgtctttaatgatggggtgccggatatccgtttaacacaaatcggacaacattccaggttttacagttctattctgaaacgtaaatccagtcagaaagcttttggccattataatcatgacggaagtgaattttttaaagagcatttatcccaatatctgaatctttcccgtggacttcctatttccaaaaataatctgctcatcacccgaagtacggaaatgagcatttatattgtttcccagattcttctttccaaaggtgataccgtattagtaggcgctttgagctacttttcagtcaatatgatctttatgaaagctggtgttgatattgtttcgattcctattgatgaagaaggaattatagtagaaagcgttcgtgaggcctgtaaaaagcagaaaatccgaatgctttatcttacgccgcatcatcactatcctactacggttgcattgagtgctcagagacgttttgagttgctggaactggccaatgaatacggatttatcattctggaagacgattatgactatgaatttcattatgataaaagtcctattcttcctcttgccagtgctgatacgaacgggatggtaatctacattggatctttcgggaaatctctggctccgggattcaggacaggatttattgtggctcctgagaatttaatgacagaaatgcgtaaatacctggggattatcgaccgccagggagatattctgatggaaagagcacttggagagatgatcgctgaaggtgaaatcaaccgctatctgaaaaagtccttaaaagtatatcaggaaaggcgtgattatttttctgcattgttagaagaaaatcttggggattttattacttttcaaagaccctccggagggcttgccatatggctggaatggaatatcccactgaatctgatgcagctgagcaggaattgtgcgaaagacaatctttttattcccaaaacattattgtatcagaataaagatcttacggcaatgcgtctgggttttggtgatctgaatgttgaagagatgaataaaggaattgaggtattttcaaaaaacgttaaagaattgataagctgattatttataagttggaaaacgcgaaggcgcaaataatggccaaaataatgcgtttttaaggcgcgaagattttatcttcgataaaatttaatactgttatttttacttttgaatggaaaagcaaagaggttatttcaaaagtgtcattctgaacactgactgaaagtctgcgaacgtagttcatcaatgtagtgaaaaatctatcagtgagatttttctttcgtcagaatggcaaatgccatattattaatcttttgagataacctcttctcattattaatgatgagtaggaaaaactactttgtttttcttatgtttgggtttcttctttttcttattcaaatagatgataaaaccggtaatcgggagtgatagtgcgataaacgctgccagaaaatagataattctggtggttagtcccaggatacttccggtgtgaagatcataatttctttcttttaatgcggttccatatccgatatttttatttttatatgattgagattttaaaacttctcctgaatattgatcaaaattaaaatgttcatttctgtattgtcttccgtcataagtcagttctgcataataggttccgtcttccgatcgagggaaattgataagtgcagattttttttctttcaatcctttttccatggtatttccaatcagattgagaatatgtgtcctgtttaaaaatttttccgaaggaattatgcttttggctttcttttctgtgggaatgtttccgtttaacgtattctttacccattgatctacatcttcaaagctccatatcaatgcggaataagagattaagagtaaaggaataatagcatagaatcccagcacattgtgagcatcatagttaatccttttccaattggctgatgttttaatgaaaaacattcctttcagcatggctttactcattttgcggggataccatatcacaaggcccgatagaaggatcacagcaaatatcaatgtggaataaccggtaatcgcttttccgattttctcacccagcagaagtcttcggtgaagatccagtacaatttcaaaaaaatcttttttggcatcttctacttcctgtacttttcctgtgtaaggatctacgtaaatccgataataataaagataagttccccaataggtccatgcttcgttatccatttttaaggtacggaatacataggttcgtgagggatcggaaggcatcactacccttttgattttcaatccttcaggtagtgctttttctgctttttccgtgagctcagacaatgaaagtttttgtctgccaatattttcaacaaaatatctgttgggataaacaatatgttttaattcttcttcaaaagaaaggatacatccggtagctgccataataacaatgataagcccggacgtgagtccgagccatagatgtaactgataggcaatttttctcaactttaatttcatccttaaaatttaaagcttacctcagcaacgaaattacgaggcatctgagctacgataactccttggcctgcaaaatactgcacattgcccaggttattcattttaaatcctaatctgtatctttctttttcaagggaaatggaagcattgactaaagtataagccgggaatgcaaactgtccggtaaccactttatttccggtaatctgttttccaacacggtttaccccgaaaccaattccaagtccctgtagtcctttgatcggaaggatataactgatccatgaattgaatacattggcaggacctgcagattccggacggcgcccttccacagcaggatcagctttttcatatttgctgtgattgtagctgtatccggccataatgtttaatccctgaacaggattcatgatggtttcgatttcaatccctttacttctttgctttccatcctgaacaacaatattgtattcttttccgtcacggattacgccgcttcctctctggatattatccacaagaatatcgtaatatccaaccgtgaaattcactttatttctccaaagatttcctttaattcctacttcccactgattggccatctgaggtttcatttccccgctaatgtccggaagctgctgcgcaacaggtgctgtatagctgaaaccattcatataattaccataggcagataactggtctttaagaatctgatatacaatacctactttcggagaccatgcagtttgattgaaatcaccgttacggatattggtattaaggttcagctgccctttactttcgtaatgatccatacgtaagcttaaaagcgtaatcaaacggtctgtaatataggttacgtttgaaatgtaggctccataaagattggatgcagaattatttcttaccaaaggagctgtggaggtctggattttctgcagtacaagatctcttgtgatattggcatatcctgctaaagtctgcccgttgatgttgtcgtacaccacaattggggaatggttgttattgatcgtctgattcagataatccaatccgatcaaaactttatttttaattttcccgatattaaattctccattgaagttctgctggatgctggtagaagaagcttctgagttctgccactgtacgttacgttccaacatcgcatcacttgtatttcttctgataaactgatattggtataaaccttccgtttttctgaagtttcttgaaatcaaagtctgtgaagtccaatgatctgaaattttgtaattcgcctcagcttttacattgatcgaaggtgcttttaatgtaatatcattattagaataagactttttccagtcgaagcccagttcatcaggattatgggcaaaataaggtcttgttctcgcaaggaagataatcggcgtattggttccttcataattgtagatctgggctcccaaattaaatttcaatctgtcattcacctgataacttattgttggtgccacaaagaaagactttctgaattcggaatctctgaatccgttctgatactggtacgccgcatttaaacggaataacatatttctggattctgtcatagggccgtaaacatcagcggttacacggttcagattatagcttcccatcaggtaagaagcttctcctccgaaatagtcttttggttttttggttacagcgttgatcaaacctccgaaagaagttacggcgcctccatacaatgtccctgaaggtcctttaatcacttccagacgttctatatcagcaggatctatctctccgttggttgttgcgggaacaccgtccaccatcgatactttggtaggaaaacctctaaggctgtagtagaaacttccgtctccggaacctcttcccggacttccctgcatttttaccatacccggaacgtttttcaatacttccgaaatatcgtaagtaagctgttccttcatgatctgctggttgatgcttgtgtaagcctgtggattttcaagcactttcaaaggcattttagccactgaagtactgtctttatccaaaaatttatttctgctcaccgcatatacggtaattccttcaatcacattattgtgtaaaggagcgtagatcgcagggatttcatagacatctttctgaatttggatgggttccctcatcagttcgatatcatttaaaaccacctgaagcgtatattctccaggtggcacattttcaaagtaatattctcctaaattattggtttttgcctggtaaggcgtgttgacaagccttaaaacagcgttttttaccggtgctttttcagacagcatgattttgccatgaatcctgtcgccctgttgtgcagaaagcgagttggaagataaagcaagaccaagaactaatataagggttttagatgttttcatgctgtaggttttgtaacagaggataatttattttaccgttttgtgataatgggaatgattctatacgttctgtgcgtacatactgcgggttgatacgcagtttatttttaatggtctcggtgatgatctgaggatctatttccggattgtcatacaataccacgatctttttatcatgggcattcagacatacgaaagtattgccctgcatttcatttttaaggataaattctacctcatcgagattgagacgtatgccgaaaagcttcatgatccgttttattcttcctgtgatgtaatacattccgttttcaccttttctggcggtatctccggtatggagtacggaaggctgctcataggcagcaagatcttccagtttattggcatagcctccgaaaatactgacatgagaaaacagcaattcatccgtttcaggatcaattttgaagcttcctctttccaccacatttccgattgatgtttcttcttccagcaatccttctgtagtaaggtaagccattcttcctcctgcttcagtctgtccgtattgtgcaaagaattcttttttaaattcatggcagtaagagaaaatcgtttttctcaattcagcgttaatcactcctccggtatgggtaaaatacctaagacttggagaatcttttctgaaaaatccaattctgttcaggttttcataaagaaagggaactccacccaaagtactgtaaccgtattcctccatttcatcccagaatgctttctgcataatgtctttatccgtacacacgattcttccggcacgcatacagttggtcgtgaaaatagagaatccgtatacaaagttgatcggaacatttaaaggaactacatcagtatccagaatcggcatatactgaagaatactcaatgcgttctgataaaggctttcatcagataatttaaccagtttcggaacacctgttgtccctgaagtactcaaaaggattttgatgtcaggatgaatggtaacttcactcttataatcatcctttgcgaagatgctgatgttgtctgagaatgctttcagactgtatccttcaatagcttctctttgcggatcaaagatgtatttagggcgatattctgcctcaatgcgttctttgaattcctcatgcagtttctgccccagtaccgcaatggtgtgtgctgttccgtaaaaattgagcagcacttcaatacttgacaactgattgtcattgtataaaaagagcagccctttttcgacggggtttaagcctaaagaccggtacagtgttcccaccggtattgttgtaccggtggaagcatctgtaaacgccaggttcttattggcaattacattttctaaaattttcataggcttagttttctacgaatacttcgtattttttcattttttcgcgaatctttccgacggttcccatctccagaatatcgttaaaatcaaacttgatctgataaaactgttcaagcgcttctacaataagaagatgagacatagaatcccattccgggatttcctgataggttagtttttcatctaccaactctttctttatggcgatagcagaggcgataatttcataaaattcttctgtagtgttcattttaaatttttatagttttccattttccatttttaaaaatcatgaggaatagtacagccaaaactatttctgaagaaacgatagcagtaaatattcctctcagttcccactgaaatcttactcctaagagataagcaagaggaagctgaatgacataaaacattacgagatacagcagtgtaacctgcatgatatttccggccgcattcaaagcacggctgatcaccatggtgaatcctaacagcagatacgccatagagaccacatggatgtattgaaccgcatatctggcaacttccggttctgtagtgaaaaatttcaccacatattccgctgcaatctgccagaataaggctacaagtaccagatacgtcatattaatagttccggctctccagactgttttttcagcacgttcaggctctcctgcaccaagattctgacctgtaagaactcctgctgcatttcctattccccacgctggcatcgtagctaccgaagcaatacgctgggcaatgatatatcctgcaagtgccgtagttccgaaagtggagataatcttcaccataatcagccagctggatgttggaatgatatactgaaccaatcctccaaaggcgagtttcagaatcttttgcagcaatggaatatcaagctgtaaaggaactctgatgctgatgctggtttttcctgtggcgaatatgaacacctgatataaaacgcctaaaagccttgataaaactgtagcataggccaatcccatcaatccaaaagcaggaataaatcctaatccgaaaacaaggatcactgcaaagatgatattggaaatatggcagatccaaagtgatttcatggcaatatcggcatcaccagctcctctgaaaagtccattgacagagagacggagaattacaagtccgatactcaggaagaccagtcttgagaatgaaactccttcatttaccgtactggcattgattcccagaaaattaacgatttctgatgcgaaaaagcaggaaaccccaccaataagcactgcaaaaaacagagccagcaagatgatatattgggctgttcttcccattccttctttatctttttcgcccgctcttctggcggtaagggttgctgctgcaattcccaaacctactgcaatggcataggcaaagttgatgtagttatcggtaattcccacaagcccaagaaccttgtcacctaattttgcaataattaatagattgacgcttacaaaaacagattccatgacaagttccatcaccatgggaatggcaagactaaagatggaacggttgatacttccggaagtcagttcaactttctttcccgctatggctccatacgtaaaaaccgctccttcttttagtatatgcaggaatttcctcatactgctgctactgaatttttattggcaatctgatacagcggatttggcagtgctccgtcttttctcggaatggcaaatgccttgttttcactgtaaccgttatttttcagacgcagactgttgatatagaatcttttgaatgccggcacatacaggtcatacttttcgtatctttcctgaaggtgggtattctcagctttataattttctacacagttgtgaaccagttcccagaatgtttcttcattaaaattggaataggtatgcaaagcattcgatagatatctgaagaaggcatcaaaaaccccaagcaaaataaacaacggaatattttctttgttggaagactggatcagaccgtctgcaaggtgtgctgggagcttttctctggcttctgttgtaagtacaatatcatccacaaagtctttgattacgattctcttcggaactccgtttttcaaaacaaccataatattttccccgtgtggcgttacacataatgaatgcgtgtaatagatatgtaataaaggcgtaagataggcatcaagatagctttcaatccattctttaatgctcactcctgctttttcagcaaatgcctgaaccaatggaactccattttcatctacataaagtaaagaagccatggttatcatttgctcatcttctttcagatagttttcagcactttctctccataatgcgccaaggaattcattatactgataaggtacgctcgcaatagctccatattgtggatgcagataggtgatggcagcctcttctcctaagaaaatagtctctttgttctcaaggtaagcatcatctttaattaagccttttacccaatctgtaatagccggagcaattttcatctgtttaggtgataatcctctgatatttcctgtgctcagaatagaaacagccgttttcaggtatctcttttcaggatgatctacattgaataaagtacggatactttgctgcggactgtatgtatcactaccctcacccaattgaattaaaagtcctgaagcaatatctcccgcaaaatggatctgaagcttatgctcccactgccacggatgcacaggaataaagtgataatcttcaacaattttccctttgcttatcagttgctgtttaaattcattatacagcaagtctccaatttcagaacgataaaactcatctctgttgatatgttccaaagactggaatgatgatctgcttttatgagaagccagccagattacttttaaattttcatcggcttcaggagcaaatgttttaagatctcttggagaaaagcctaatcggcttttgtttacaattatccatggatgtccggtcatattgtgctctacagtttgataatctgcatccgcaagatcttttgaagatattactcctcttgataaaattaaagcatcacaatacagcgtatgtagtaattcttccgtgtatcttgcaatcgtataaggatctaaatcaaatacagactgcatttccaggaaaaaagcggctacatctactgaagacaaatcttcaccgttttctgtttttgtaatgctgtctttatcaatatgccagtaatccatcattctttcctgtccgcggaagctgtatgaaatattttcaactccggtttcaagggtaaaaacagtatatccgtttttattttcaaaggttaccacaggttttagaagctcttcatgcatcagctctgcgacggttttggccattaggtttctgttggcctgattccagttttcctggcttactgtattttttaagttggtgttcattttttgattaaattttggcagttggtaaatcagcatatttttctacatcgaaatcctggaaagcaattttcttttcaattttataatgctctcttcccagaatatcattgatgatgtaggaattgcggtaagcagccattccaagatctgtagaaatatagctgtgagtgtgtacttcagcatgaagcacatagatttctcctccgttgtggtctattgaataatttctgttaacatcaaacaatccgctggaatctctcttgattctatcctgaatattctttaagaatgcaggctcgtgatagcggtatcctgttcccaaaatcagataatcggcttcctggtcataaggaacttcctgttccagttgggtaaactcaagattgatgaaatccggattgctgttgtctactctattcagctgactgttaggaataattttaagattaggatccgcattgtcgatattcaaatcataaataaaatcgtaaatatcattgatcagatcgtaattgattcctttaaactgagcttgctgcttgcttaaaatggttttccttgaagattcacttctgttgtagaaatagtttacataatcaggggatgtaagttccagcgtcagtttagaatattccatagggaaaaatctgtccggacgggaataccatcccagttgtgtctcttcatttctattttgaagaaggtcataaaaaacttctgcggaactctggccagaaccaataatcgctatttttttaccctgagacaaaagctcttcttttctgtacagataagaactggtgtgaataacacgggaatcatcttttggaatgaaagaaggaatatgaggttgtgttcctgtacctaaaatcagtctttccgttttgaaaaccgtagtttctttggttttggtgtgaatcgtcgttacatgatataaaccatcttcataagtaatatccactacctgagtagagaaacggcattgtggaagctgttcaatcacccattgacagtaacggttgtattcttttctcggaatgaaaaaatcttctctgataaaaaacttatacagtcttccggtttctttcagataattcaaaagacttaaaggatttgttggatcagccatggaaacgcagtcgcataaaaatggagtctgcagggttacatggtcaatcatcagccccggatgccagtcgaaaccatctctctggtccaggaaaagggttttcagttccgaaattggattggataatgcggcaagtcccagattaaatgggccaatccctatgcctattacattgtatacggcttcgttagtcattttttgtgatgtttgtggtgatttgtacctccttattctgtgggaatttttcccagtaccattctctgtaacagaagttcagattggcttttttatgaggcatttcaattactttatctactttgaagcctacatgagctttgttcatcatagacgcaagcgagtctacagacccttcgcctaccatttttcctacctgtggctgtgcaaaaacatagtcaaccatagattgtgtcgatggagagacgaattttttctttggatcggtaggtgcaataaactggtgggttccataatcggtaggcagtacttcataataatcgcctacaatatctctgcaagcccaatacacctcgatattacatgaaggttcgtcattccctgcgatgatataactgtgtgcttcatcacttggaagaatcagtctgtaatacgtttccagttcatcaataggccagttcatctgccagatttttacggcatgttcacggttgaaccattcatgaagcatttctaggtcattttcaagatctataggacgcatactcatcgtcacatcttctttctgaaagtatcttttaaagaaaacctctgttccctgcggattgattaactgatccgagaagaaatgtttgtgaagaaggttcggaactttagcataagaaattgaagaagcatttacacctccgtctacatcagcaaccgccgactgaaggtttgattttactgcccaatatctttgattcaaagcataatccgttaataaggaaggttcagtgccatgaaggttttcaaattccctgtacaaaatatggattaatcttctttctttaaccaagcctgttttacctatggaagcaatcagtgcactcaggttgcttaccagaagatggtgagaaacaatatccagaaggcgctcatctctgatgaaaagatcttccacttcaggatagcctttgatcagagattcatattttcctttgaagctttctttgatcagatatccttgtccgtctcttacataaatagattgaggaagaagctggttatccaattgaataagcagattctgctgatgaacttcaggagccatccctaattgattgtataacctgtttaaaggggaaagcaatagatttacatacttttcaaaccagattatagctgctttttctgcatctacacctaattgattcgcaacatttttaaagaaatgtgtagtaaaattgaaaccatctgtagattcatcctgacaaagccttgccaatagaatcactttatcttcatttgaaaaaggattttcacggagcagaatattcatgctgtccatattttttccttcataatgaacgcttaacgtggatggttccagtaataatttaaacttcgggaaatcttgtttaaataaagctttttgatgctgccaccagattgcggaagcatagcctctgttgagatcttttaagctgtttgttctcacagagcctgtcattaaaacatgcagagagaactttaacatccagctgaaatccggattgtataccgttcttatggaagatgttgcataaaaatcttctcccaatggtccgatgtgaatgattttcccagaacctaacatttccggatattctgctgtggataaaagatattgtgcttcccatggatggcatggaacgatgtaaaaatcattgatgttttcaaaatcgtaactttccggtaaagaagtccatttttcgaagatttcttttgcagaaattcctggaagagatttttctgtaatacagtctttatgaatcaggaaataatccaactgaaatcctttcccgaattccggaccgtataaaagctgttcttcctcagagaatcccattcttgatttggtgaaaggatgcagattgtgtcctgccggaagcatttgctcagattcaaggaaagaataggtcaacagctgatcatcctgaagacaagcttctgttgtcagttccagatttcttaagctgctttgaattctttccacaaagtttctgaaacccgtttcgttggtagtttcggaaagttctctgtaaaccaattcagtaagcttttgatcattcacttcaaaaacttcttggttttgatgatctaccgcccacaaaacaggtccgtattcatgaaaaagagtttcggaacgataggaaaccggagcaaataaaaacagtccgcttttcttcatttcaaatctcataaacaatgaataatcactgttttgaagagcttttgctgtaagaagatcatatttcggaacgccctgatagaattttccgtttcccagttctctcagcattccgttcaacagaattctgaaagtaatttctctggctttttctcccgttctatttttctgaattaaagtcttttccataatttttgattgtggtgagaatctgatgaatgtcttccgtagtcgtaatcgggttcaggaacgtaaacttcagatagaagttgccatccactttggtacttgctacaaggatttccccgctgtagaacagtttcatcttgatatattgattcagtgcattcagatcactgatttccggtcttacatatctgaaaacaagaacgcttaagtcggaatctgaaaggagttcaaaatctgcatcttcagagatcatcgctgcagcatctttggtaagatcgatcacagtgtctgtatattctgtcagctgttctttacccatcattctaagggtaaaccaaagttttaacgcatcaaatcttctcgtactctgggtaatggatttattgatctgtgccggaatctcctcttcgtccatttctttcggattcagataatcggcgtggtgtttaagaatcaacagttcttttttgtttttaacaatgaaagcactgctgctgatcggctggaagaatgatttgtggtaatcaatcgttaccgagtctgctcgttcaatcccgttgatcaggtatcggtatttttcgctcaatagtaaagcacagccatacgccgcatctacgtgcatccagatattatagtgttctgcaatattcgcgatatcatccaatggatcgatatttccaaagtctgtggttcctgcggtagccacaataccgataggaatatttcctagttgctcttccctcttaatgtatttctttaaaagagaaatatccatacggaaacgttcatctgtaggaactttaacaatacttttctcacccaatcccataatggatgcatttttcagattgctgaagtgagatttatcggaaacaaatattctgaaacggcttgcctcggccggcagaccatccattttaatgttgtgattatatcttttctgagaaaaacaatcacgcatcatgaccaatcccattaaattactctgtgagcctcctgcagtgaaaacaccgtcgctttcattcgcattatatccgatctgaccggcagtccagtcgatcagttttctttccatgaaagttcctccggcactctgatcataagtatcctgtgaagaattgatggcgcttacaaggatttctcctgccaatgccggaatcactacagggcagttaagatgagctacatattgcggaaggtgaaatgctgtggcatgttttacataaatatcatctacctctgccagaagctcattataattggaaagtttttgattaaggtcgatctgttgtaccattcccttcattgttttggcttctataccactgaaaggtctgttgtttctctgaagaaattcctgaaccaggtctaaagtactgttgacagcattacgataatgatcataattgtcaggatggaaaatatttccaaaattccctgaaatgtggtgtgaatttgtgctggtgaacacttccagggatgttaaattattgttcataaatgttttttaatgtgatttttttaatctgtgagttgttgtggttttcgtgatatattatcttatatatctttaagtcagttttttaaattttgcattttttattatatttttatttggtgattacgtaattattactaaatttgactcgactattgttatttagaataattaaaaacaaagataaaaattattatttaacatcaaattttttttaatgaattctacacaaattttagataaagactgtttaacagcagtaaaactgcttcctacggtcatagaagtcacctctcaggagagaagaatgataaaagatgcggcgctgcatcttcagaaaaaatatgacacttatgaaaaccgggattttataaaacatgttcatcaactggcttcttattttcttccggaaaggattctgaatatagcagctgattttgcgagtgacttttctgaaaatcagtatggagcgctggtttttacaggattgatggagatagaccaggaggaaataggttctactccacccaactggcaatcggcagattattcaaagtttaatttatatggttttgcgtgtgcgcttattcatggggcacttccctcaaagcctgtacagtattattcacagcgtaaaggcggtggattgatccacgctattatccctgatgaaaaaatgaaggaaacgcagaccggctcagggtcttcaacggatctgtatgtacatacagaagatgcttttctgaaacatcaggctgactttttaagctttatgtatgtccgaaatgaagagcaggtaccttcaactctttattctatccgttctcatgagtctattggtgaaaagtacagagcactttttgagcctatttataaaatccctaaagatgccaatctggaaacgggagaaaatgaagaagaaactctggattctgtattgtatggcaataccaatcttccttttatgcgatttgatgcggcggaacagcttttcaattccagtatcagacagtcagaagaagcacagcatgcactgcatgagttctgggaagaagccagacatttgatttattcaggatttacgcctcaggccggagatgtcattctggttaataatcatttatgtgctcacggaagatcggctttccgtgcgggagtaagaaatattgacggtatagaacagccgtgcgagagaagaattatgcttcggatgatgagtaaagtgagccttattgatatgagagcacatacccttacagaagatcctttttttgtcatagaagaacatctgggtaaaaactttcaacatttttaagatgctgatgggttaactttttgaacattcaatcaatcaaaaacctttttgggcgtagctcaaaaaggtttttttatttattcctaacccgattaccctttgttaagtttcggctaaagccattaaaatttatatttatttattaaaacgggctaaagcccgcttctattgattgtttatgataaaattggcttcaaccaaaatttaaaaaaggcttattatttaaaaaacctgtcaaataaggacaattgttcagacaaggatctgctccaatattcaggaacgtgccctcccaaagattccgtgtagaggtgctggatcttcatttctgtcagttttttatgaaaattcctgttcatattgatcatttgagtgtcttctgtaccacaatcgaaaatatattgctgatctgctccggccatcagttttattttgctgtccgtcaggaaagcaggattcaaagactccaatggccccagaaccttatttaccatgtatttctgatagccttcaccgaatgagttaaagtccagagcaccgcatgaacttcccacaataccaaatgttttgttataagtaactccaatgttggttgctccataacctcccatactccatcccaaaattccacggaattttttatccgctttcacaggataatttttatcaatgaactctaccagctctttaccaataaacgtctggtactgggaatccttaacaatcgggctgtctacataccatgaactgtagtttccatcaggaagtacataaatggtttttaattcctgagcttttttaaccagatccggaatatcctgcttaatgattctgtccggatttccgctgaaaccatgaaggatataaaccgacggatattttgtattaggctgaaggtttggcgtaatgatcaccgttttgatctttttgttcattttcggactgaaaatttcctgatgaataattttttgtgctgataactgtacaaatacagtcattacaaatacaatgttgataagctttttcatactgaaaagtgtttaattaataatagctacaggtatattttcctaaacatataatataccaatgatctttagacaggtcaaaattgtgaaattaaaaaagggaaagcctcaacatatgttgaagcttttgttaattcttttaataaaatcagatcagtcaatgattagtatttccaaagcattaatcctgcctgatagcctgttcccagtgtccatataagaatataatctccttttttcaatgattttacttctttttgatattggtctaaagctaaaaatggactggatgctccggtatacccaagctctttagagtaaaaaggaattttttcctcaggcaactgaaagtaatcgcggataatattgatattcctgatagaaaactgtgaaaataaaaacaaatcaatctgctcaaggcttatctgattgcgctttaagaacagagggatattctccagtgcaaaattgacacttcccattccgtcgaaaatacgatcccaggttgtcagatcgccatgatgatgacgtgaatttcctttaggtgggtagagtacggtattacaaaaactgctgtctgtatgatataatacatctaataaccctgaggtgtcgtccccatcattttctacgataaaagcaaaagcagaatctgaaagacaaaaagcggtaatcgggttgtcaggatctaatatcctagaaaatttttcggcacaaactaccaaagcttttgttccggaccgggttcctttcaaatattttgatacctgatccagcgctataaatcctccaatacagttggcattaatgtcatagcataaggtattcggttttccgttaagcgcatgatggatctggatggcgtcacagggaatatgatgttcgggagaactgcttacaaaaataataacatctatatcgagaatagaaatattactttctttaagaactcctcttgcagcttcaattcccatagaaagtgtagtttcaaaggaattctcaggaacaataaaacgttctgccctgcctaaggcattctgaattttttgcattgaaatttcctgcctttcaaagtggtcaataacagctgtgttgttttctacaaaatcgggatgatagaaatacgtgtgatgtaatctcatgtctggtcaatattttatttatatctcttatttgtgatataatgtaaatttaacataatgatacaatatatcccagaaacatgaaataaatcactttatcgtttgattattaaaagtgtgtggtaatttaatcagtatttatctccattaatctcctttttgatccggctgagctgtgtaggtgtaattcccaagtaagaagcaatatgatgttgttttaacctgttataaagagaggtgttttcaagtagctccaagtatcgtttttttgccgtttcgtatttgagagaaacttccaggggttctttgtttaccacccagtttttttcaagataatacatatgaaaaagagcgaggtcatgatatttttttaataactcacgataagcttttgcaggatattgtattactgaacagtcttccagggcgataatattgaagtcgctgggttcatttttaataatggcggccgtagaagcaacaaaactgttttcctcgaagaagattttgtaaatattatttgcctgttcatcaacagtataatagcctatcaatcctgattttataaagtaataataccttgccatggtacctgattccagcagaaggtcattcttgtgatagtattcttctgtgcagatatccaataaatctttaatagtttcctcagataaaggataatatcggttgatctgttttataaattcggagtttttcatgctaatatccagaaagtatgagaaatattatgtaattatctgtgtcgtctgtgggtaaaaattaatccagtatttttttcatcataagatcggtctgctcttcttctcccagtctgaaaatgtgtttatcaaattcaacaaatccgtttttactgtagaaattgatagcccgaaggtttttctcccacacgccaagccaaaggtatgatttaccaagctgttgagccgtttccagagcctggttataaagaagcttccctacttttttcccgtgatgacttttctttacataaatcctttcaatttccagactggtctcatcctgaagctcagtctgcgcctttccggaattcactttcaggtaaccaaccggattgtcttcttcccaggcaatatagaaaagagaatcaggattattcaactcagactttatcttttcagtattaaagctttcttccagatactttttcatagcctcttcagtattatcttctgcaaatgtttcagtgaaagtctgtatagcaatattttgtaatgtttcgagatctttttctccggatttaataatgattactgatgacatattgtatatttattgttctaatttattaataagattttttatttccggcaatgtaagttctgtttttgcacctgtaactaaaatattttctaaaattgcgctatgggccgtttttaaagcatcttcgcttttgactttctgatcagggattactccaatatgttcccagttcttaccagttgctaaagaggttatttttcctgccggaacaagcagtaaatattgattccggaccataaagtgatctacaggattggcggcaccccctgtcgtttcacctattacttcagcaagtttattttgctgcaaaaagtaagctactccctctcctgccgaaaatgtctttttactggtaagaatatagatatttttatggaggtatttttgtccggtaactttagtctgggtactgttgataactgttttatgatcatgtctgaaatacgtggtataaagatctgttttctgatcaaaaaagtaacttaaaaacaaaagaagcataccgttttctcctccaccgttttctctgagatcaataatcagggcatgggtattcgccacaaaattcatagcagcagccagtgttttttcactggcagcgggagaagcaaagcctttgtaattgatgtaaccaatatttcccggaagtcgctgtactgtttcaaatccaaaattttcaagacggttgtgatcattgtttaacgcctcttcttccttctcgctcatctgttgttcaggagtatatttttcaagatatttcacaaaaaaatgttcatccttaacagtggttctcagtttttgggtgagaaatgctgcaaaatcatttttattgagtgggttaaacgttccttttttcaattcatcctgaaataaagaatctacttttttaaaggcgtctttgtcaatataatagtctttcaccttttttgtaatatcagaaagtacagcttgaacatcatttttctgcgcagctacgaataaggagataaaaaagcagaaccctatgcctatttttttcattgaaataagtatttaatatttcagcaaatgtatttcaatgaagttgatgggaattgtaaaaatggaaactcagataaacagccagatattatttttctcagtatctacatgctcaaagaattttccgggattgattctggtaagctctttaaaatctttaataagatgggactggtcataaaacaggttctcataagaaagctctgtaagatttctggtctttttatttgaaatcagtacatttcggaaacgctggatttttctgaattctgaagctggtttagcgaggtatcgccgggaaatcttattcacatactgccttgttattttatttttatctgcaatttcttcgatgctcatttcggtttcaaaatcattcaaaatgctgtaagccagctgtaaatctttctttatgaatttggaaaaccagtatttttccagcatttcaatttgtatatttctgtcagattcttttaaaataacattcatgctttctttaaaatcagaacaatgaatttcctgctgaaggtcatcgcttttagcggcatcataaaaatgataaattcctaatggcttgaagtaaaccgtaacttcattaacggattgctgataaagaatttcggtaggaacagagcatctgaatacaaaatcaatcacaatattctcagttgcagaccttctgatttctacccatcctttattctgaacaatagaaacatcctgacaagctgacacgataaaataattatccggaaatgtgaggtatctgaccggctgatggctgtcatctttttcaacaaagtaatatccttcaatatattctttaagaatgggatgtaaaggttgataaaaagtgactttcatactaaaggagtgaaggtaaaaaataaacagaaaacaaaatcctgaagcgtgtccaggattgtattatttatgaaaaaagaatcttcttaaatgcttcagaagccagatgtacctgtacgctccagtcgtctgcggcatcgcttcctgcatcatcagaaatatatttcaggcataaaaacggaatattttccttttgggcaatcaatgccagtggataggcttccatatctacaatattataatcggtttcggaatggttcatttcaaaactgtcgccgctaccgcagatgccttctttcaatgcatccattttaagaccgtattccaatacaggtggcactccggataaaggagtttcatataatttaaatccaagccctcttacatccatatctctctggatgaattttgtgcagcataccacttcacctttgtgaaatcctttgcttccggcagaacctaaattaacaatcaatttaggctttctggcatgaatttctttggttagttctatagcagcattcacttttccgatgcctgtaattaatttatttttatcgtcgaaaacggttcctgcttcagaatctaatgcaaaaacaaaaagggtatcatcaattgagtaatgactttcgttgttaatttttatcattgagaaattaggtttatacagctgttgacattgtattacaaagatacaataggttttcctttttttgcattaagaacaataaatattatataacatacaataaacaaaaacaaaggaatcttgaatgcaaaataattaaacttttctatgggagtttgcactatcctgctcataatgggtgaaagcatcatcataaaacttaaaattgttatgggtactttatttttccatcttgtaacattaagtatagcacctaaaagccctgatatagcaaaaatttgttctatattccagaaatcaaaagcagtaaatagaagccaaaaaataaatggtaatcctatcatttgtcccattaaaataatgaacaggtaagaaataattgaggtatatttaaaaatgttaatgttcattttcttaaatattaaaggatttcattgaagtctttcaaatatataaatattcaaatatatacctaattaaaaaccccaaaacaaatatttgttttggggttttcatattttaaatactgcatccatcagcatcgcatgctgctccactgctaccggaaagatctttaaacggactcaccgtttctttataggtttgctgaagtgcattttcaaatacttcggcaggctgtgctcctgaaacggcatatttaccattcagaacaaagaaaggaactccggaaatcccattgtttcttgcctcctgaatatcctggttgacttcatcatccagttgatctgttgtaacagcttctctggcttcatctttatcaagtccaagactttcagcaagagcaattaaaacttccgtatcacctacatttttaccgtcaataaagtgagcaataaataatgcctcttccatttcattggatttgttgtgcttcttagctaaatgaagcaatttgtgagcgctgaaagtattggtgatcaaagtttgtccaaaattaaaatcaattccggctccttttcccatttgggtaacctgtcccagcatttgagtagcctgagcttcggcaactccttttttctctctgaaatattgaagggtatcctgagttttgttcggatctaaagttggatccagctgaaaacttttccattccacttctacttcatctttaaatggaagtttacttaacgcctgttcaaaattattttttccgatatagcaaaacggacacattacgtccgaccagatttctattttcattctattgaattttaaatcaaattaatcatacaaatttactacaatttatttaatgtaacaaaaattattacatttagtttttgtatctcaataagtaactatcagcgttctaaaatacccattaaaataaataattatttccctatggcagctttatttactttttttgaaaacaaaatatgcgcaatcagacccaatactccaaatgtagtacctacaaagcatacaccaccccattgtgccttttgccatgcaatagaagccagccaggttcccagcgatccaccaataaagtaagataccatataaactgtattcagtctgtttacggcattggatttaagtaaaaaataattggtctggttcataatatggctggattgcactcccaggtcaacaagaattactccgacaataagtccccagtaggtttctcctgcaaagtaggtaaatccccagcttccaatgacaatcagcagggaatacaatataatccggttaatatcaagatatttttgcagttttcccacctttgcagcagccaaagctcctaccgctcccgccagtccaaaacttcccactacagaagaacctgcattgaaaggcggtttctccatatggaaaaccaatgtcgtaaataaggcacacatagacccgaaagccattgccccacggaaagatgccagctgaagaaccggctgggttttcgcaagatgggcaacagaacgcatcagttctttataagttcctttaaagttcggaggtaactcgggcagcattttatagacagccacccaaaccagaatcatcagtcctgctgcaataccaaacatcgctctccagccccacacttcaccaacaatacctccgataaaacgggataaaagaattcccagcagcaatcctgacattaccaatccgatattgcccgatttttctttatctgatgaaagttctgctgcaataggtacaaaaagctgtggaataacggaagttgccccgatcagaagacttgctgcatacagcatccatagctgattggcaaaagtcatccatacaagtgatccgaaaacaagaaataaatcaattaaaattaattttttacgaaagaatttatcacctaatggtacaatcagtaataatcccaatgcataaccaatctgggtaagcacagaaattttacttgctgaactctcagaaatctgaagttcttctgaaatgagggccagtagtggctggttataataattattggcaacaacaagtccggaaataatagccattagccagataaccgtccgggaaataccatgggtagaactctcctgcattacgtataaaattttgtttgaaatgaatctttctgacgtttgattttatagggtcagattttttaagagatcaaagataatcattaaaaaaagaaatttcccggtttaagacttcacattttttataaataatccctgaggctatggtaagtagaatgatttcaacaggctgccggatcattgtttttattcatgatatatattgatgaaaaaccttttacatattggaattattaaagaaatttgcagcatgaaaatcattccacttaaagaaggtaatttttcggcaagcaaaaccaaggattttacacttttaacagatgaaaattttgatcaggttggaggaattaaaatgtctgtacagccttttctcatcattactgaaaatgattatattcttctggatgcagggattggctggaaaaatgagtccggtgcaacggtaatttctgaaattctggaaaaggaaaatataaatcctggccagatcactaaattattattttcccatcttcacaaagatcatatcgaaggagcggtaactcttaaagataatggttttgaagcaacttttcccaatgctcagatttatatacagaaacgtgaactggattttgcgatggaaaatgaaggcaatccttcttttgattttgatatgctggaaaaattgatccagctgcccaatattatctggatgaatgaagataaaggtcagattacagatgaaatttcatatgaagtggccggcgggcatactccgtttatgcaggttttctggatcagggaaaatgaggaaacggttttctatggtgccgatgatcttccacaggcttcttatctgaagtatcatctggcttataaaagtgactttgatggcaggaaagcaatggaattaaggcttaaatgggaaaaagatgcacgggagaaccactggaaaattctgttatatcatgatctggatcaggctgtcatagaactttaaacaaaaaaatggtttaaatttcattaaaccatttgtagatatcaaattccgaaggaatattaagtttttttctgatcctgtttttcctgttttgtatggctttgggcgttacaaaaatacaggttgcaatttccttggtggtcatattgagcttaagatagatacaaaagatcagttcagagttttttagcgaaggctgtatagcagataactttttaaaaaaatcaggatagacgagtctgaatttattcagcaaacgtggagaatttgctttggccagtgccataatttcgtcttgtacaagaatcttttgattcaaatcctcaatattcggttcagtttttttgtttttcataatactttctcatctctacttatttcaaatgcgacatcttttgcgcatcagtacaaagtctttttttctctgatctgtgttttataggttaataatggaatgaaataatttctatatagttaaagttttcacattttcaataattataattcaatagattgcaatatttaagttgtattaagttaataaatgtgttaaaaaaaaatctacttgtgaatttgtatcatttttaccttggcaaagaaagaaaaaatgattaaaatttaaataaaaccgcgtaccacatagataccacgttatttttttaagcaaaagatcataacagcttttatcagccagtttcccattatttgcaatgtacttctgacgggttgtaaatgtagctgattaccgttatatctttttatgatctcaatcaatattgttaaaagaaataattaaaaaaagtgaatatgtgtggtatatgaatggtaccacgttgttcaaaaaataaataaaatccatgttcctttattttaagaaaatttttaaacaagaatagtacgaatgttcatttaaaaaattaaaataaattacaatatgatcattgaaaatttattgatttcatttggtgccgaaattaaagattataaggcggaagatattattttccgggaagaagagtctccaatgtattattaccagattgaaaaaggtaaaattaaactcaataattatacagaagacggaaaagaatttatccagaatatcttctcagacggtcaaagtttcggagagtctttattgtttgtggacagaccatatcctatgaatgccgttgcaatggaagattcaagtgtattcagaataccaagacagaattttatggacctgatccgcaataatcccgaagtttctttaagtgtctatgaatgtcttgcggaaaggatgtattataaatacctcatgttgtataatctttcttttcaaaatcctgtatccaagctgaaattacttatggattacctgaaaagttatcatgaggaaaaaacgccctattcttttcaggttccgcttacgcgccagcagcttgcttcacttaccggattaagggtagaaacagtgataagaaccataaaacaaatggaaaaagatcagatggtaaaaatagaacgccggaagatctattattaaaataaaagccggatgtactccggcttttattctattttgtatgacaatattctgcccgctcctattgatcaagctgtctttgaaattcttccaggtatctggcaatatgaatcccgtctgccaatccatgatgtgcttcaacagaaacaggaagatattttctgccgtcacggatattgaatcttccaaaagcaacttttggtacagattcttgtgtattaaaatcagtaggctgcaatatcgcactgaaagagttccagggaatagtggtatgtcttacatgatcctttcccagtctttcattgcttaatctcagtcccgaagtctggtgaactccttttatttcctcctgcaaagcagcattaaatgtttcaaaatcctctgaataatgggtgaaagaaaaaccgaaagttccatccggtcttccgatggtactgccggcatgaaccgtgtcaaactgtacaacctgcccgtcaacgattctgagttttaattcatcaactgtattgatcgcgaccatagacttatgaaaataataggcaaaaaaagaatatcctttttctttggctgtttcgtatgcttttgtacagtctacttctgttgtaaatccaaaataaggacttgccatattagagaaaaattcaaaatgttctttcctgttccagttatctatgtctacaatcttcatgaactcttattttttgcaaatttctgaaagtttctccggtttaaaaaatttatgactgaaaatataattaaaacttaacgttacaagaccgttgtttggtagacattttgcagcaaaaacaacacatatttgcagtttacttatttgctgcataactcttttttattcaggaaattgacattacacactatcgaattaacaataaattatacaatatggcaatggaaaaaatcggatttatcggattaggaaatatgggacatcctatggccaagaaccttgaaaaagcaggctttcagctatctgtttacaacagatctgctgaaaaaaccacagattttgaggaaaaatcatccgtctgcacccaaattaaagaccttgtacaaaacagtgatattatattcacaatgcttaccaacgataatgctgtaaaagcagtgtatgaggaaattctccctttagatattcagggaaagctcttcgtggatatgagtacaatttctcccgaaacctccacggaaacagcagcagctctgaagataaaggaagcttcttttattgatgctcctgtagcaggaagcactatgcctgcaaaagaaggaacgctcattattatggccggaggtgaagaaaaagacatcgagcgggccatgccctaccttttgaaaatgggaaaatctgtaaaacatctcggtgaaaacggaaaaggaattgcaggaaaactatcagttaattattttctgtctgccatttatcagggactggcagaaactgtattgctggccggaaaattaggaatcgagcggtctgatatgcttgaaatcattaatgaaagtgccagcggaagcggtgcaacaaaggtaaaaacaccactgctgattgcggatgaatacgccccggcctttgctcttgatcttatgctcaaagacattcttctggctaaaaatgccggtgctgattttcctttatcagaaccattgattcaaacgtatcaaaatgcacatgacaaaggctttggtcaggatgacgtaatagggattatcaactatctaaaaacaatagaataaaacatgctgatatgaattataaaggaaaacattggtctgccagaaaagcagatcaaatgtatatcgtaagtattgaaaatcattgcaacattgtggagacactaactgattttatcagggatcagaaaattcaggcgggagaagtaacaggaatcggagcagtaagtgaagcaacacttcgtttctttaatccggccacaaaaaaatatgtagataaaacctttaaagaacagatggaagtcaccaatatttccggaaatgtttcagagatcgagggaaaactgacgcttcaccttcacattacactgggaagagaagattacaccgctttggcaggacaccttttagaagcaaaaattcagggagccgcagaatttattttctatccgttgaataccagagtggtaaaagttaaaaaccaagaaacgggaatcaatctttatgattttgaaaaataaatcgttggaaattgtcgattggataaatgctttacttaaagttcaaagtttttgaaaatgcaaaggcacaagatttaattcctgtgcctttgtatttattttaaagttgtgctttttaatggttgcattaaacttcagtagtggtcattccgaatttctttttgaatgaagaataaaagtgcgataaattctcaaaacccagatcaagataaatatctgaaggtcttttatccctgttttttattaaataataggcttccttcaatcttttttctttcagccattgtttgggcgtcatccgaaatgttttactgaaatctctcttaaaccctgaaagactgcggcctgtaagctttgcaaaagtaccaaccgacacattgaacataaaatttctgttcataaattcttcaagatcaattttatgaggttctgagaaatcaaaaagaagatttttaaaatcaggattgctcagtaaaagcagctctatagcctcctttacctttaaaatggccagttttggaggtatctccttagtcttattgatataaggaataagagaagcaaaatagcttttaaaaaaatcatcaggctcaaaaaataatcgttgatctcctggaaatccagtttgcacctttattttgttttcagcagcatattgtctcaatgtttcatcgtcaagtgtgatagatacaaactgatatttctccttggctgaaggatatttgaccgttctgatcagctggtttttcctgaccagaactactgtattttccttaatcactgtttttccgtgttcatgaaaagcatgtgtttcccctgagatctgaaaccccagaaaatgatccgggataaactcttcatgacctctgtaggattcaaaagcacatgaataaaccagtttgtcaaatatgatctcagtaatattttccatgatacaaatatctgaaatttaagctatagcctgcgctcctgcttctgctatttccttatcctgttccggtgttcctcctgaagaacctatggcaccaataatctttccggatgtattttttatgacaacacctcctgcaatagtcagaagtccttcattcgaattcagcattccataaccatgaatacctgtttcagaaataattcctcccattacctcactgtttactccaaacatcactgctgttttagcttttttaacagcaaaatccatcactccgcagacactgtccagtcttgccagtgcaacaagatgacctccggcatccatcacggcaatacttacaggaatattcataaataatgctctttcctttgctgcatttaaagccttttcagcaagttcgtaattcatttccatagcactagctttttgtgttccatgcctctgcctgaagctgttttacaaaatcctcagtttcctttggatgtacatttctgaaattacattggtcatctaaagctacatttacaatcacttcagccatagactgcggatcaagttgatgtgctaacgattcagcagcaccatcaaaagcagattccggggtaaaattgatcttcggatcataccaatggaaaatagagtctactcccctgtcattaaatccggttccaaatacacccggattgcaggttgcaattttaatattaaacggagcgagttcagttcttaacccttcagcaatagattccagcgcatgtttggaagaacaataagctgcaacataaggaacagtccacaaccctcccatagaggaagtaaaaacaattttaccactcttcctttcaacaaactttctgataaagccctgtgcaagattcaatgccccaaacacattcacttcaaacatggaacggataatatctaccggctgttcagcaataggaccgccttccataattcctgcgttgctgattaagatatctatttcatactttttcaggatataatcaatatctttttggctggttacatccagcttatccactgtaagatcaattccctgttccttagcctcgcggattaaatcactcatttgaggataaacctgtgcggtagcaattactttatggccctttttagcaagatcaaaagcagcaatctttccgaacccgcttgctgcacctgtgattaaaattgttttactcattgtattcttttttaatgatgatacaaatttcaaagatttccacaagggtaatattgcctgaaagctcatttttatattgctggaaagttcataaaaacgaacagaggatgaatagctttcaaatagttcctcttctaccttataaaaatacaggctttttcgaatcgaagcagctttttttaatctcttttcatactttcaatgattaaaaataaacggattgttgtaaattggttaagtttttgaaggtactctacaaaaccagtcacaccattgaaattaatcacatttacaaaaaaaggaatttactgtccccagggaaaattttatatagacccctggcgacctgtagatatggcggtcattacgcacggtcatgctgatcatgcccgctggggaatgaaaaaatacctgtgtcatcatttcacaaaacctatccttcatcagagaatcgggacggatatcgaatgccagagtatagaatacggagaggttgttaccattaatggagtaaagctttctctgcatcctgccggacatattatcggatcagctcagataagacttgaatataaaggatatgtaaccgtaatttcgggggattataaagtacagaatgatggactcagtacccctttcgagctggtgaaatgtaatgaatttgtgacggaaagtactttcggtcttcccatttacaactggctcgaagttccggatctaaataaaaaacttcagaactgggtactgaaaaataaagaaaataataaaacatcagtcttcattggatattctcttggaaaagcccaacggatcatgaaggctgtggaagaactggggaaaatatatgttcactattctatcggaaaacttaatgaagcttttgaaactgtgggaattgatcttcccgaatacacaattgcagatttcagggaacgtcccaaagaagtacagcatgaaattgtcattgtaccgcctgccttactggacagcaatatcatcaaaaagattcctgatcctgctacagctatatgttcaggctggatgcaggtgcgcggtgccagaagatggcggagcgcagacgctggatttgccatgagcgaccatgccgactggaaaggattattacagaccgtaaaagccaccgaagccgagcttgtacatgttacccacggacagacagaagtattttcaaaatatctgaatgagatcggaatcaaagcagatgttgtggaaacattatttggagacgacgaggaagaatccgaaaaagaaacccttcaaaccccggaatcatgagacactttgcagaacttatcaacgcgttggaaaccaccaataagaccaacgctaaaattgatgctatcattgattacctggagcgtgctcccgatgaagataaagtatggtttattgccttgtttaccggaaaaagacccaagagaaatgtgaataccaattacatgaaagaatgggcacttgagattacgcaacttccctactggctgtttcaggagtcttattcttccgtaggagatcttggagaaaccttatcattgatactgcctcctccgcaggaaaaaatcgagcgttctttatcagaatggatgaatgatattgttaatttaaaaagcaagacggatacagagaaaaaagaatttgtactgcagtcatggaatggcctggattatactgagcgtttgattttcaacaaattaatcggcggaagtttccgtatcggagtatcagataaaacattaatcaatgcgctgaccagattttccggtcaggaatccagtgctttaatgcatagcctgatgggaaaatggcttccggatgaagtgtcgttcaaagagcttattgatgcagaaaatgttaatcccgacaattcaaagccttatcctttctgccttgcctatcctttggaaaaagaacctgaagaacttggaaatcctgatgaatggctggtggaatacaaatgggacggaatacgcggacagatcatacggagaaatgatgaagtcttcatctggtcaaggggtgaagaacttgttacagaacaatttccggagatcagggaagttgtacaggcaatgaaaggcaactttgtgctggacggagaaatattggcagtaaaagatggtaaggttttaaatttcaacgaactacaaaaaagattgaacagaaaaactttaactaaaaaaatgctgtcggaaatcccgattgaagtttttgcctatgatcttctggagtttgaagataatgatttgagagagaagccgatctctgcaagacgtgctttgcttgaagaactattattgaatgaaaatcctcagaacatcagcatttccaaaagcctggagtttgaaaaatgggaagaattgaatagcctcagagaaaattcaagagaagtaaacagtgaaggattgatgctgaagcaaaaacactctccttatcattccggccgtaaaaaaggtgactggtggaagtggaaaatcaatccgtttaccattgatgctgtgcttatttatgcccagaaaggaagcggcagacgaagtgcttattataccgattatacttttgccgtgaaaaacggagacactttagtaacgattgccaaagcctattcaggtcttacggataaagaaattatggaagtaagccgctttgtgaccaaaaatgcaattgagaaattcggtcctgtaagaacggtaaaagctgagctggtattcgaaattgcttttgagggaataggtttcagcaaccgccataaaagcggtgtggcgctccgtttcccgagaattgtaagatggcggaaagataaaacagtagatgaaattgatgatttggaagaaattaaaaaattaatacaatagattttaatgcaaggacgcaaggactttttatgatagcgtaatagtaaggcactctgctaagctatagtaagatattgcctttgctgagtgagacgcccttatgatcggaaaataaacaatattaaataaaaacttagcgcccttttgcgttaaaaatttaaataaaaatagaattggcagcttttgaacatagcaacggattaaagatcattcagcaatggatgaccgataaaggcattgccccttttaaatttcagctggaaacctggaaaaaattcggaaacggatatagcggaatggttgtggcccctaccggattcgggaaaactttttctgtctttttagcattggtttcagacttcctgaatcatcctgaacaatacaaaaaaggattgaaaatgatctggatcacaccacttcgctctttatccaaagatattgcaaaagcgatgcaggaagccattgatgaaatcgggctggattgggctgtcggcgtaagaaacggagatactgatcccaaagtgagacagcagcaggtaaaaaaaatgcctgaaattcttgtggtaactcctgaaagtcttcacttacttctggctcagaaaaacaatgaagcctttttcagggatatgaaatgtgtggctgtggatgaatggcatgaattactgggttcaaaacgcggtgtcatggtagaacttgcggtttcacagctcagaaaatacgtcccgaaggttaagatctggggaattaccgccacgatcgggaatctggatgaagccatggaagttcttattccttatgatattaaaaagacaaaggttacggcgaaagaacataaaaaaatagatattctgcctgttttcccggatgaaattgaaattttgccatgggcaggacatctgggaaacaaacttgcagataaagttgtcccgattattctcgaatcaaaatccacaattgtctttaccaatacaagaagccagagtgaaatgtggtatcagcttcttttggatgcacatcctgattttgccggccagatcgccatccatcacagttcaattgatgcgcacctgagaatatggattgaggaaaacttaagttccgggaaattaaaagctgtggtttccacatcctccctcgatctgggtattgattttaagcctgtagacactgttattcaggtaggatctgccaaaggagttgcgcggtttctgcagagagccggacgtagcgggcactccccttttgaaacctcaaaaatatattgcgttcccacccactccctggagctgattgaagtttcagcattaaaagaagcagtaaagcagaaagttgttgagcccagggaaccccaggttctgtgcttcgatgtattggttcagtttctgatgacattggctgtaggagacggtttttatcctgatgaactgtatgaaagaatcaggaaagtatatgcatttcaggagatgctggatgaagaatggaaaagtatcctggaattccttaccatcggcggaagtgttttaaaaagctacgaagaattccataaggttgtcattatggaagacggactttataaagtaacttcaagaaaaatcgcgatgcttcacaggatgaatatgggagtgattgtaagcgatgccatgctgaaggtgaaatttatatcaggaggttacattggaatgattgaagaatattttatttccaaactaaaaaaagaggaaaaatttattcttgcaggaagaacactggaagtcgctatgatcaaagatatgacggtgtatgtaagatctgccaaaggaaaagcgctggtaccaagttatctgggcggaagacttcctttaagttccaatctgggacattttttaagagaaaagctttcccatgcattaaatcccaaagcatcagaaaaagaacttaaatttcttcattctttattaattaaccaggaaaaaaattcccacattcccaaagaagatgaattcctggtggaattgattaaaaatcgtgaaggataccatttatttatgtatccttttgaaggccggctggtacatgaagtaatggctgcattaattgcttaccgcatctctaagctggctcccatttccttttcgatggcaatgaacgattatggatttgaattgttcagtgataaggagattccgcttaacgacgaaaatctgcaacagattttaacccgtgataatctgatgaatgatgtgattgccagcatcaattctgccgaaatggccagaagaaaattcagggatattgccgtaatatcaggaatggtgattcaaaattatgcaggacagcagcgctccaacaaatcgttacaaagttcagcagggttaatttttaaagtgctggaagaccatgacgccagtcattttttaataaagcaggcctatacggaagtctttaatatgcagcttcaggaacaacgtcttgtagaagcttttaaaaggattgaaaagtctgaaattattttaaaacattcccgttcgtttactccgctcagctttccgattaaagtggacagcctgaggcagaccctttccagtgaagggctggatgcaagaattaaaaggatgctgaaactctctgatataagtgatcttttataatcaattaatatgttttctgtaagaccagatatgccgatgaatatttgtttatcgcaaagacgcaaaaattgataataataacgttttaaggcgcaaagattttatctccgataaaatttagtcacgttaatcttgctgaaaatctttgattttcttacgccttaaataaaaatggataatataaaatttgcgcctttgcgagattttaaaatttataaaatcaaataaaaaacctgtctttttaatcttattcatgacttaatattctgagttaattttcttgataagttaaaataatcatcgtaacttacagtaaagctttacagaagtttaaataaatgtaaataatggaaaaattattcttggtccgtcacggacagtcactctggaaccttgaaaacaggtttacaggctggaaagacatcgatataacagaagccggtattgaagaggcaaaaaaagcaggacttgctttaaaaggagaaaggatagatatcgctttcacttctgccctcatcagggcaaagcacacactctccatcattctgaatgaaataggaaatcccaatatcccggttataaaagataaagctctgaacgaacgttcttacggaaatcttgaagggttgaacaaagcagaaacggcacttaagtatggtgatgaacaggttcatatctggcgcagatcatatgatgtggtacctccgggtggcgaaagccttaaagatacatacaacagggtaattccttattttgaaagccagataaggccgttattaaaaaagggcgaaaatgtactgatcgttgcacatggaaatagtctccgtgccctgatcatgtatctggaacatctttctcctgaagaaattctggaaagagaaattgctacgggctttcctctgacgtatgtttttgatgaaaagtttcacgtaagccggaaagtaagctgattcggttaataaagcttacctttgaacattaaatcaattcatacagcgtgtttatagctaccaaaagcatttctattcagaacgaaatttttatcctaaccaatcagcgtgccgcattctgggaaaaagaaaaggcacttgttctttctgatcttcacatcgggaaaactgctcatttccgaaaaaatggtattgcactgtctaaccatattatgaaaagcgacctggaaagattatctgcactgattgaattttttcagcctgaaaaatttgttgtggtcggggatttactccacgcaggagacaattctgatgtagatgagttctgcatatggaaatcacaatatcctgaaatacaattctatcttattgaagggaatcatgatcgcttatcaaaagctctggaagaaaaactatgtttcaatcataagtctgagatgctcgagataggagatattacttttattcacgattttgatacaacaagaacgggatttcagattacaggacatatccatcccggaattgtactgaattctgctgttaaaaatatcaggcttccctgctttgcgctcagcagcgaccaattattactgccggcttttagtgaattcaccggattggataccaaaaacctgcctaagaaaagtaccttttttgtcttcacggatgcggagatttatgaaatctgatctatctctgaccatagatccgtgctaagattttaagtcttagcacggatatacatcagataaaactatccctgaaatcttaacctttcttactcaaacggatactgtacagtgtgatcagtacggtaatcaccagaaataatgcaccgatccatggtgtgcttgctaatcctaaagatgacgtcacaataattcctcctgcataagatccgatggcaataccgatattaaatgctgcaatattgattcctgaagcgacatcttctgttccgggaagttccttttctgcaatctgtactaccaacagctgcaatccgggaacagaagcaaatgataatgctcccagaaggaaaagtgtaatgatacttaaaacaggactgcttaccgtaaagtaaaacgcaaataataccaatccctgagccgcaaacatccataaaagtgccttaagaggatttttattggccactttcccgcccaggagattccccagggcaatggcaattccgtagatcagcaggatgaacgtaactgttgattcctgaaatcctgtgattttctgtaaaatgggtgacagataagtaaaaactacgaatgttcctccatatcccattgctgtcattagaaaggcaaaaatcaaacgcctgttccccaatactttaaactgacttcttaaagaagctgatttcccgtttttcagggtgttgggaaccagcaataaactggccgctaacccaatgattccaagaattgaaactcctataaaagttgctctccatccgaaatgctgtcctatgaatgtacccagcggaactcctgttacaattgccagtgtgagcccggcaaacataatggaaatagcagtagccctcttttcttcaggcaccagagaagccgcgatggtagagcctatggaaaaataaaccccatgagcaaagcctgtaagtattcttgccagcactaaagttataaatccgggtgctatagatgccaatccgtttccgataacaaatagcagcatgatagacactaatagcatctttcgtggaacttttcctgttaatgccgttaatatcggagctcctatcgctacgcctattgcataaaggctcaccagtaaccctgctgaaggaatgctgattccaagatcagaagctactgtaggaagcaatccgacaattacaaattcagtggttcctattccaaaagcacttatcgttaatgcccaaagtgctgcaggcaaaccttttttaatagtttgtgatgctgtattgacctgtatttctttttgataattcattgtcttgtattttgttgatattgacgaggcaaatttccggcgaataattgtattataaaaattatttaaattgtaataaattatcagaataatgatagttttattttacacttaaaatttgttcctttgcagaataatcagaagttttaatgaaaaaatcagaagcaacccgccttacgattctccagaaagcgttcgaattgatctatgtaaagggttttcagaccacaagcattgatgaaattatcgcaacgactcaggtgaccaaaggagctttttattatcattttaaaaccaaagatgaaatgggccttgctattattaccgatctgatgaaacctaatttcaaaaaaacttttattgattctcttcagaacagcaagaaccctttggacagcatctatgatatcatgcaccatcttcttatggaaaatgattttctgaaagttgaatatggctgtcccacttccaatttcatacagcaaatggctccttggcatactgctttcacacaagctttgcacgatctttcaaaagaatgggagttggctcttgctgaaagtatcgaaaaagggaaagaatctggtatcattaaaaaagaagtcagtgcaaaggaagtcagtgtttttgttatttcaggctattggggcgttagaaatcttggtaaacttgagaattcaaaagaagtatatctcacttatttaaaaggacttagatcgtattttaaaaccctgcaataatttttttattcaaaaacatactagttagtatgtttttattatacctttgctgtgttcaaaaaaataaacgatgtatcagacccttacctttttacattcccaaacccgatggctggttttactcagtctgatttatgcaattttccgtgcttttaaaggttatttttcagaccgcaaatttacaggagctgacaattcagtaagacattggaccgctaccattgctcacatccagctgattctaggaatggtattctatcttaaaagtccggtaatacaatacttctggaaaaatttcaatgcagcaaaagaatcttttgaacatctgtttttcgggatgattcatatttcattgatgattgcagccattatgatcatcacaataggctccgcactggccaagagaaggcttactgacaaagaaaagttcaaaactatgggaatctggttctccattgcactgatcattatttttattgcaatcccgtggcctttttccccatttgcaaacagaccttatttcagatagattatgatagaattattgaaaacaaaaatcggccggttaagaattctggcaattctggaaggcatttcattactgagccttgtatgcattgccgttcctgtcaaatactggatgggaaaccctttacttgtgcggttattagggcccgttcacggaacattattcctgctctttcttttcaatacgctgagtgttggtgtagaacagaactggaaattcagagaaataacatggaaggtaattcttgcctgtttcatcccgtttggaacattttatattgacaaaaaaattctgagcaagctatgaagagccttatcatcatctgtggaatagcctttatactgtatgtcgtatacagagtttaccggtttcagactttagatgacgatcttcctcaactgctcaggaaaggagcagttatcctggatgtaagaactgaaaaggaatatgaaacgggacatatcgaaggttctgtcaatatttcactgggaaccatcagagaacgttatgtagaattagacccgaaaaagacatacatcaccgtttgttctcacggactgcgaagtgtgaaagctgaaaatatactgaaagaaagaggctttaaacatgtttataacggaggagcgtggagtgatctccagaaaaccatcagcaagtaaaatcatttaatccctctgtgattctcagagggattgaatttttaaactgttttatcatccagccatactactttctgatcagataaatgctcctgccctattatttctctgtataattcaggtcttcgggctttaatatatcgatatcctcctgcctgggtaagcttttggggagtgatcaatgcagattcaaaactgtcttcccacgaacggcattctgcaatcacatctccgaagggatctataatcatagagcatccgtttttcagctggtcatcatccattcctacagggtttgaaaaaactatatatatcccgttatcataagctcttgccggcagccatttcattaaccagtctctacccttcatcccattgaattctaggagtaaagaagtaggatctgcttctctgttttcccagagctgagaatctacaaaaccggctccgggccttgtagaaggagtacacattgttacgtggggcataaagataatttctgctccaagcaaccttgtagcccttacgttttcaataatattgttgtcatagcagatgagaataccacatttccaacccatgatatcaaatacacaatattcattaccaggtgtaagatgaggattaataaaaggatgcagttttctgtatttagccttcagtccggttttatcaacacatacatacgctttaaaaaggttatcatattcatccttctcgaataaacctgccaatatggtaatgttattctgagctgcaatctgttgtaatttccggatactttcaccttccggaatacgttctgcaatattcaaaagctcttctctggaaagctttcgggcaaaagtataacctgtgacggagcattcatgaaatgcaataacatcagatccttgagcagaagcctgctgagccagtttttcgatgacagagagattgtatgctttatctccacttttgttttcaaattgtgcggttgaaattttaatattcattgtttttttaagcaaagctagacgctgttacttttaaaaaattgtataaaaccgacatgctttttacaactcaatgaaattaactgccattttattttctgtgttcagatattgctttggagtaagcccggtattgtttttaaactctctgataagatgcgactgatcagaatatcctgtttcgtatgaaaatgttgccatatttttatgatcagcacttctgtttatcagacttaaaaaataatgcagccggataatattgctgtatttttttggagacattcccatatgaaattcaaatttcctttccagatggcgttcagaatatccggtgaatttttccagatctccggatgttaccaaacctttgttctgaagaatatattgttgtgaagcagcaataatttgatgatctttattcatgctctcagacagaaaatgagtaaaaaacaaattcagatcattgataatatgcaaagggtttattttgttaaaaagttgttcctgaaaagtttgcagtttattcttcaacacatcttccacagaaacagtctgattagaaatctctctggcagatgtatttaaaataatattcaaaaaataaggttgaaatacaacagcaataagggaaaatttatcttttgaagaaaaatctttatatccgtttaaaactccgtaaaaaaaagaaagcggcatcttatctccggaaataccggaatacagattcatatcgcctgataaaataagcccggagctgccatcagtaaacagccttagacttctgattgtcttttcagaattttctaagaaaatataatgcctgataaaagcagccaaatgtttaggaggtgaaatctgcatataccaaatgtacataaaacttgccggcagaaaaactgtttttgctattcaaatttcttacaagggctgataagataaaagttatcgtttttaaacctccaataaatattttatgattttgaaagaaatcaatcacaggtaccacattttgtttctttttggtcaggtatttgaaagacttaagcaaattattcatcattttgatgtataaacctcttttaattaacattaatcacttaaaatatttaatatgtcaacagaaaatcttacccacctggaagcgatcaaaaagattaaggaattatcagaaagtgcaagaatatgcatgttctgtacagaactgggcactattcctgtcaattcaagacccatgacccttcaggaagcagacgacagcggaaatctttggtttatcagcagtggaacaagcaataagaattttgaaattaaagaagaccgcagagtacagctgttttttatgaataacagtgactcccaatacctttcggtatatggggaagcttcggtttatagggacaaagcaaccattgaagataaatggtctcctatggcaaaagcgtggtttgatggaaaggatgatcccaatgtaaccattatccgcgtagaacctaaagaaacttattactgggacactaaggcaggaaaactcgtaagcctttttagttttgtagcagctgcaatcaccggaaaaaaaactgataattcagacggtgtagaaggaaatgcaaccatttaaaaaaatctggatagcaataaattttctcacagattttattgcaggaacacaaaaacggctcaagaaattgagccgtttctataagattaatgatgctgatttttcacatcttccaaagatgttccaaaattaatatgaaggacattgccgttcggggttaataaagccggtacagactttacccctgcgtgctcagcgtcttcaattttgtttttatcatttcccagatggatgatttcaacattttccaaacctataagattaatcatatcatgctctgcactgatgcagacaggacatcctgcatgataaaaaatggcttttttcataagattatattaattactaagtgttttaataatattttttaattcctcagtttcctttttatcaagcggctttaagggacttcttaaatttcctccgttttccccaagaatattcagtccagatttcaccgctctcggtaaacctttgctgacaataaattttaaaaggtcaaactgctgatagaaaatttcttttgctttttcaagatttccctcttccactgcatgataaagactgatattcagttccggaataagattgggagcagccgtacaccaacctcttgctccggcagaaaatgcagccagcgccaaaggattagaaccgttgtagaaggcaacgtcttctcccagttctctactcagataatgcatcctctgaacatctcctgtgctttctttaatcatcgttatattgggaatttcaagcaaccttttcagtaaggccggtgacatatctaccccgcttgttgccggattattgtaagccataatcgggatagaaattttacgtgctacagcatcataatgcgaaacaatttcgtcgtctgtgagtttccagtagctcataggaatgatcataacggcatctgctcctgctttttcggcaaactgtgcatggtgaattgtcttttctgttgtaagattggaaactcctaccagcgttggaattcttccttttacctgctgcaaagtagcctctgtaacttcttctttttcttcatcagacagatagggcattacccctgtacttcctaatggcgcaatgccgtggcttccggaagtgaccagtctttctacaagatgtttaaaaagaggaatatctactttttcattattgtcaaaaggcgttatgggataggcgataatccctttgaatggaacatttttcatgtttttttgatttacaaattgaaaataattttaacctcttaccttaaaggtctctgccttcctcttctcttaatgcgactcccaaattctgcagctgaggagcattttcgcaggcaatgtatttggcgggttctgtatcgctcaggttctggtgtttatgccaggcccatgaaggaatatataccgcatctccggcttcccaatataccctttcatcttctacttctgtccagccttttccttcaatgacgaataatacggtttcatacgtatggcgatgtctgttggtttgctggcctggaagaagtccgccgatcgtcatgctgacattcttactgggaagatctacaaagaaaaccggatgcttcctttctgttgaaaactgattgtgcacaccagcattttctacatttttatgaatcaaatggctgggctttacatactttggtcttgcaaaagtttcgtgaaagtctttagaactgaattgtttcttgtccataatttaaaattattaaggttttgtgctttattgcatgacaaaattattttatatttggactgtttaaatgattcagtttttacataaacagatagtccagatgttacgaccttggaaattagaattagaaattgataaaaagcttgatcaacccgtttatctgcagattgccgataccattatcagggatatccgttcaggaagactgaaacccggtgatgctcttcccgggagcagaaatcttgcccaaactttgaagcttaacaggaatactgttgtagaagcgtatcaggttctgatgaatgaagaatgggtgatttccaaagaaaggaaaggaatttttatatcagaaaatcttcctgctttacatgagaaaaaaacaggcagaatacaggactctttgaatcaggagatgatttccagtggaatgctaatcaattttgatgacgggcatccggacagtaagattgcacctgtaacagaactggcaagagcttacagacagattttcagtatcaaagctaaatggcagatgatgggttatggaaatgaacatggcgatgttgaattccgtaaaatgatttcccagatgcttaatcatcagcgtggaatgcacattcataaaaatgaaatttctgttacccgaggcagccagatgggaatgtttctcacagctcagactcttttaagtcccggcgacattgttattgtagaagatccgggatatcagcctgcatggcatgcttttgaatatgccggtgcccgacttttgccggtacctgtagatcaggaaggaatcagtattgaagctgttgaaatgcttctgacagaacatcagaatattaaagccatttatattacgcctcacaggcaatatcctacaacagtcactttaagcctttccagaagattaaaattaattgagctttccaatcagtatcatataaccatcattgaggacgattatgacaacgagtttcatttcgggtaccgtcccatccttcctgtttcaagttttccggagcttcacaactatgtttatatcggaacattgagtaaagtggtagctcctgctttgaggattggttacctggccactaaaaatcagaaattactgaaaaaaatcggtgatctgagaaaaattattgatgtgcatggagatgttatcatggaacaggctgttctacagctgatcagagaaggtgccgtgaaaaagcatatcagaaaagcaactgttcattataagcataaaagagattttgtttatgagctgttaaaaaagcatatggcaggtattgcagatttcacattgcctgaaggtggacttgccttttggattgttcctaaagctcaatgggattgggatgtggtaaccgctcttttattggagaagaatattaaaataatccatccgaaacaatacagtcagaataagattaacggcttcagactaagctacggagccctttctgaagagcagctggaacaaagtattcctttgattgctgaagttttttcgaactcttttaaccattgatttcacagactacaaatatctcacaatcaaaaatcaaataaaaattgaagatttttaaacttatataggcttttaagcagtatatctgtagcttaaaatcaacttaagtgtttttatcttttgtgacttttgtggtttagttttaataagaactattccacttcaaaaatagcctgaatttccacagaagaccccacaggaattgatgttgctcccaaagttgccctggcatgttttcctttttctccaaagatttcaaccgttaggtcagaagccacattcataagctctgcatgttttgtataatcctcttttgtattaaaaattcctgtaagctgaacacattgttttactctgctcaaatcccctcctacagcttcattcaatacagaaatgacgttcagcatggtaacttttgtagcttcttttacctgctgttcatttacttcagcacctaatttcccgggattgaagattttgccgtctttcaaagcaacctgatttatgaataccagatttccggagcgtacaaaaggctgataatttcctgccggttttgggacctgcggaagggtgatatttttctgtttgagtatttcagcgaagttctgatgatgctctgcaacaagtgcagctcttttcggacgggtatcttttaatgccagcgctacctttgcaaagtttttcccttgtaattcggcaatattccgctcacctttggtcggtctttcaacatcttttaaagaagccatacttgttactcctaatacggtatttccctgtggaatagctttgttcagctcttctgtcccacggatgccgttaggcaccaatatcattccgtgaacggcaagactgttccagaatgcctgcatggccagctcttttcctgcaccacttcctgctgacataaaaaccgaagccggaacaccttctaaagcatgattggtccaaagctggacggttttagctaaaaattcactcattcccgtactgatatttccgaaataaacgggcgaaccaaaaacaattccgtcataacctgtcagttcgtctacggttgccaccggaagatttttaaggttaggattttgtgaagatttgaccattttgatataaggaactgcattattttcactttcaattcctttagcaatttctttggccagttcatacgtcccgccattatctgaatggataagaaccaatatttttgttttattttgtgccataatgatgttgatattagtgaatacaattaaaataaaaaagagacatcgttttttcattctgaacgggataggttatttttaatactttattgcagtacaaaattagtattggcgtttttattaaatttgccaaaatatacatacaaaacgacattatgaaatgcggactgattgaaaagacggaaagccattttatcgattctattgaaaaagaggcttatatctggtgtgaaaaaaactggaaacatgatgattatgaacacaggcatagccgtgctcagctgacttttgtggaagaaggataccagtatttccatatcgacaggaaaatttatcttgtcccacagcatcatgttatctggattccttcagaaaaaggtcataaaataacttctgaagcacaaacggtgaatctgatggtatttttgttcaaatccgtttttgaagacgaattttataagaatgttcaggtgtttgccgctcctcctgtattaaaggaaatgcttttatatgcttcaaaatggaatcaatcattaggtgaaaatgaagaacaggacgtgttttttaaagctattttaaaaagtcttcccaacttttgtaaggaaagcaacagtctggaaattcctgtacctgcagatacaaggctgattcctgtatgtaatgaaatcaatacccattttaaatataatcttgatatcgattctctggctgaaaaagcacaaatgtctgtacgaagcttacagagaattttcaaaaatgaaacgggaattaccttgcaaaaataccttcagttgacaagaattttaaaaagtatcgaactgattgacaccagacaatatactttaagtgaagttgcttataaggttggctatcagagcctgtctgcatttacttcatcctattttaccatcatgcaggaaaagccaaaagtcaaaaaagatcatggtgtctcgtcatgaggcatatcaaccggttttgattcgggagaacctttttcgcgaagccatatggataaaataaccagtgaagctacagcgagaaattcactctgccagttctgaaaagactcaaaccagaatcttgattctgaaatatactgcattgccgttacggcaggtttactgttcatcagctgttcatcattaaaatccttaaggcttccatagaaatgtaaaataaagctggccaggaaaagaatggcaaaagcaatggataaggaatgtttatagagtttcagccatattcctccttttttgacgggccatggtgctttgggatgcggtacaggctctttgtcaacatcttcctcttctgtcatggatttcgactcactggagcctttctgtctcagagaaaccgttagcaaaacatagagcatcatctggagaaattcgctttcccagttttcaaaagttgcctgtataaaatggccgctatgaatatattcacctatctttaatgcaggctgtccattttcaatgagttctttgttttctgttttccagcccataaagaactgtcctgcaagaaaaataaccatcagggtaatcagaacaatacttaagctgttgcgatacaagaaactggtgcgtggcatatttctaagtttttagtttaaaattcaaggtttaagatttgagatgtagcatttatgaatcatgtttctgataagggaagactttctgcagatttttggttgtcggaccggtaagtattttcccattcacattgaatctggaaccatggcacgggcagtcccagcttagctctgcactgttccaccgcacttcacatcctgcatgcggacaggtacttctcagaagatgtaatgtaccgtcaatctctttatataaagcataagattctgattcgtaccgtataactttagcttcaccctcaccaatttctgaaaaggactctattttatctttaaaaattttatcttttacgaagtcaaaggctaccgctgcattttctttcacaaaatctgagaatccggcaacaggcttgattcttgaagggttgaacaaatcaccgtatttactttctcctgtaacaatcagatcatgcaggatctgtgatgaaagtgttccgaatatcatcccgtttcctctgaaccctgtggcaacaaaaattcttcccttactgccgggaagttttccaatatacggaagaccgtccaccggctcataatattggctggaccagctataatacactgtttccacatcaaagtattctctgacataattttcgagccttgaaaagcattctccggtatcttctgcatgtcctgttttatgatcttccccacctgcaatcaaaaggttttcaccttcaatattctgaatacggtaataatgataaggttcacagagatcgtaaccaagcgcccacggatagcggtcgtttttcagagtaaatgccatcgcatagcttctgtaaggtgcattcgtaaaatgaagaacattcactcccggtggtatgtgggttgcataaacgatatttgcggcttttatttctccttttgaagtttttaaagtaacatattcttccttctcatcatgatcttcacagagacagttttcctggatggaacctcccagctttataaaagcctcacaaagtcctttgatgtattttatcggatgaaaatgtccctgtccgggaataactactgcttctttgaacggtataggaaaaggagtttcattcacataactcatttcatggccaactttatcagctccttctacaatatttttcaattgttcctgttgcttttcatccagtgcaagaagataggctgattttctggcaaaatcgcagctgatgttgtattgtcgaatgcggtcttcaataatttcaatagcatcacctccggattctgcataaagtctggctttttcaagaccaaaatccctgatagcctcgttgaaggtagtatcaaaaaaatcatttaagtgagccgttgttcctcctgttgttccaaatccgatattcgcagcctccagaatgatgcatttctttccggattcctgcagcttcagcgctgttgacactccggtaattccgccgcccactatggcaacatcaaatatctggctgagatcagtttctgcagaaaattttctgacttcttcctgccatatactttttcttgcaccgtctctgtacataattatttttttttcagttaaacttacctgatgttcagggtatcgctttcagggattcctgttttagcagtagtggcatgattgttcttttgatctctttttctgttttcgtcttcgtcaagattgcatctgcaggaagtaaaagtaaacaggcttaaaacgcctaaaataagtgctgttgttttcataatgtaattttttaatgttgagtatctatccgttcacaattaaccctccattgggatgaagcacctgtcccgtaatctgcgaggcatctttactggccagaaacagaaagctggaggcaatttcttcaggagtggcatttctctcgaacggaggtttgttggggttttcttctttttcgtcaaatgtttcttcagtaagcggtgttgctacagggccgggcgcaacggcattaatccggattccttttggttttgcctgtaatgccagtgagcgggtaaaagaaacaatagccccttttgtagcggaataatcaagaagctccggatggccctggtacgcagaaaccgaggttgtattgatgacacagcttccttctttcagataagggaatacgaccttcgtcagtaaaatcattcccacaatattggaatcaaaggtttgtcttatattcttttcctcaagatcttcgatcctgtccgcaggaaactgaataccggcattattgatgagaatatcaatttttccgaataccgagatcacttcctttactgtttcttcacagaattcatagtcgttgatgtctcctttgaaaataatgcattttctattcagcgtttcaatttctgcttttgtttttcctgcatcattatcgctggagtgataaataatggcaatatctgctccttccatggcaaaaaggagcgctacagccttaccgattccactgtcggcaccggtaattaaaacagatttattttttaattttccgatcataccgttatttattatttttccaatgtgggtttttgcatttcatacattctgtgggcagccatactgtcgctggaaatattagccatggcgacggaaagtttattttttaagcccgatactattttatcatctccgttcatcagagcattgtaaccgtcaatagccacttcttcaggagaagcgagattatctctgtcttcaagtattttacttgtgttcatatccgctttattgaagaagtccgtgtctgtaggtcccggtaaaagtgccgtcactgtaattcctgagtcttttaattcttcacggatagcttcagaccatgataatacaaatgctttggtgccatgatataccgattgccatggaccaggcgctttactggctacagaagccagatttaaaatttttcctgatcctttgggcagccggtccttcaaaaacagtttggtcaatatgatgacagaaatgatatttaactgtataatgtctacttccctgtgaatatcggtatcctgaaattttccatagacaccctgtccggcgtcattaaccagaatttcagggcttatcccattcattttcaactctgaatacagggaataagcttcttcttccagaaaaaggtttttggagatgctgatcacattcactccaaaatttttaaattcatcagacttttttttcagctcttcatgatttctggccacaataacaaggtcatagccattcttggcaaacagtttggccagttcgtagcctataccgctggtagcacctgtaatgagtgcaaattgattcttgcgatccatacattttattttaagattaaaagtctgttcagctcacttttaaagcagcccaaaatgaattccgtataataaagctgggcattcagggcttgtgttttgggatgaagctccagttttttagtcaggataatttcacctttgtaagagaatgagaaataggcgaaaattttatatccggaattgcggatcggtgtgcagtagcctgtggtggcgatagaccagtcggactcataaagtctggctacattcaatgccatggtttctgcaatattttctgaaacacaatcgcattcttcggcttcctgtctgttgacctttagcagctttactttttcctgcaaagaataagctgtcatacctcctttataaaacatagaggcattcggcatctgtgaaaaagccagctgtaaacatcctgaagtgacactttctgccaatgaaatggtttcatctgtggtcatcagtgactggcttatatattcgagaagattcttctgaaaatccatactattaattttaagtaattgattgataattgtatcaaaatcctgtttatttccacgggtcaagaacgacctttacacatccgtcttcttttttatcaaaaatttcatatcctctgcttacttcattaagagaaaggcggtgggtaataacatcatcaagtgtgatttttccggtcacaacataatccatgagttgatctatgatgggatgaacattacattggcctgctttaatggtaatccctttgtcaaagatctgtccaagtctgaaattgtcataattgacaggatacactcccagaacagaaacaataccacccctgcggacagcgctcatgcatgcttccagcaccttgattgagcctttttcaaagttcaaaacagcttttgcccggtctataaagctcctttcgggttcaaagcctacggcttcaatacaaagatctgctccgcgtccgtctgtcatatccctgatcttttctatcgtgctttccgcatcttcccacaaaatggtttcgcatcctgtaagcgttttgatacggtcgagcctgtattgaagggtatcaacaacaatgatcttctttgcattatacaagacagcacttttggcagccattgtgcctacgggccctgctccgaaaatgacaacagtttctcctcctttaagttctccccacatcacgcctgtataaccggtggggaaaatatctgtgagaaataaaacctgttcatctgttaaattgtcaggaacctttctgggaccaaaatgagcgtagggaactcttacatattgtgcctgtccgccatcatatcccccatacagatctgtatacccgaataaagctccgcctttatctttaaaaatacctccttccggtccataataatcggggttactatgctcacaggcagtaggaagatcatgctggcagaagaaacagctaccgcaggcaaccgggaaaggaactacaaccctgtcccctaccttgagatgggtaatgttttttcccttttcttctacaatacccataaattcatgtcccattaccatgggtcttgcctggggaattcctcctgaatacatgtgcaggtcactgccacaaatagcagtggaggttactctgaggataatgtcattttcatccagaattctgggatcttctacggtgtcacaggtgatgttacctggtgagtgaaaaacggctgctttcataatgtaaatatttaaagtgattggtgttggtgtgaagggtgttttatgattacgcgtttctctccgtttcaagatcccagactctgtgctgagcaattgcctggatgaatttatctgcaggattcccgtcttcccatgtaatgattccggggtcctcatgctgttttgttgctacgttggaattctgatacaggacttctgtatcttttccgaaataaatggctttacaatgtttataggcttcgttgatgaaatgcagtacctgatgtttgttttctgaagtcataagctcctttacagcatcttctcccggacagatggcaagagcatcaaagcatacgcttgcaatactcgtaagagagtgttttggtatgagttcagaactgtcatttaatcttaccggagcaacacttggtgctatcagttctactctggcgccctctgcttcaagctttgttttaagatcattcaccgctccgccatcggcaccattagccaggataaaacctattttacggcttttgattgtattttttaccgtatgcgccatgctcagtgcaccggaaaattttgtgtcaggttctctctcttcgctctgaagttctataatattactgtctgcaggcaagctttggttaggccattccagttttttgacttctacacctaatttttctgcaacgctccatgcaagagacatatcaatatatgccagctgacctaccagtctttctctgatttccggacgggttacttttgacagttcaaagatcaatgcattctgaaggtgcattttttccggtgttgactggctgttgtagaataatttagcctgagaataatgatctacgaaactcttgcttctttctctgattttcactccggaaactctttcctgctgagaggtaaatccaccttcagacatcattgcctgaaaagggcatcctccaccgatggaattcggttcataactgctttttcctttgacaatctgttgtctcatatggccatccctctggttattatgaacggtattaagggatctgttaatcggtatttcatggaaattgggagagcccagccttgacagctgagtgtcggtatatgaaaataatcttccctgcagcaacggatcattggtgaaatcaattcccggaataatgtgtccggggtgaaaggctacctgctcagtttcagcaaagaaattatcaggatttttgtttaatgttaaagttcctacaatttctacgggaacttcttcttcgggaactattttggtaggatcgagaagatcaaaatcaaatttgtgttcatcttcttcaggaatcagctgtacgccgaagtcccattcaggataatcgccgttttctatggcttcccaaagatctctcttatgaaagtccggatctacccctgaaatcatctgggcttcgttccaggctacagagtgtacgcctaatctgggtttaaaatggaattttacaaaatgtacttttcctgcctcattgatgaatttaaaggaatgtactccgaaaccttccatcattctcaggcttctcggaatagctctgtcactcatcagccacataatcatatgcatgctttcgggcatcagtgatataaaatcccaaaatgtatcgtgagccgatgctgcctgtggaatttcattatccggttccggttttacggcatggataagatcaggaaatttgatagcatcctgaataaaaaacaccggcatattgttggccactaggtcataattcccttcttcagtataaaattttacagcaaatccacgtacatctcttgccagatcagtacttcctttgcttcctgcaacagttgaaaatctcacaaaaacaggtgtttcttttcctaattctgttaaaaattttgctttggtatattctgcaaggcttttggtaagcttaaaaataccgtgggctccggaacccctcgcatgaactactctttcaggaattctttcatgatcgaaatgggtaattttttccctgagaataaaatcttccagtaatgaaggaccacgttctcctgctttgagagaatcctgattgttattgatctttaaaccctggttggtggtcagtttttcattttcgttggaagtgctgtgcaggtcaagctgttctgcttttttgttgtgttcgttggttttcatattcataatctttttttgtggttgatctgtttttcaaaagcagttaataagggggcgacagaattaatctgttttattttccagaatttcaaggaacctgttgatatattcttcctccttcagaaccttataataagccgttttggcatataaagtgaaagatggagattcaaattttatttcagtatccatttcagcggttcccatcgtatttttagtatggaattcccggatatgaaggaggtattcatttatataggtgtcaattgtatgtttcaggatatcacatttcgcattatttttaatcttttccaaagacttgatcagaaaagcagttactccgtaagaattgataatcggcggaaataaagacgcattctctattgcattatttttatcattcagcccggaatgttgtaaagtgtcgttttcaaatatcatattctaaaaatggtattagttgtgaggagcttttaaatattgctcaaaataatggaggtcgtttttatctttaatggacagataaaacatgatctgttccggttcttttaatccaatactgctgaagctgtcgaaatgggcaattagtgcctgaatattttcaatatcaatatctttcagaataatgaacagaagaaaaatattttctctgatctctttggcatacactgctgctccgtcttcaaaacacttccctgtgtgaggtatttttataaaatctttgtgtctcagtttttttattatgttctgacagtccatatattttgatttcatagttaaaaataagccacatagaacaagctacatggcttattgcatgctttaatcttcctgttctgcatcaaaattgatggatgtttctgcaatatcggtaagcagggaatcagtatcttcttcttcctgaagtgttctttccagaaggtctgctgccttatcgtgccccatggtaatggcaagctgtgcaagtccgccgtaggtggcaatttcataatgttctactttctgtgcagcaataataagggcgacatctcttgttgcagagccatcttctgtggctttgatgacttcttcgccttcttctataattcctttgatggccttacactcttttttttcaggcttctcgtcaataagctggaatactttttccagacgtttcacgtgtttttgggtctgaagatgatgatcctcaaaggcatctttcagctcttcagtagtggctgcttcctgcattttctccagagcatccaggatggcattttcagcaaaataaatatctttaagtgcactcacaaagaattggtgaagcggtgaacttttcatttcgtcttctttcacagttggcttatctgcagttccttttttagtagcagaaacagcactattggtttctaatattttatttggcatggtatgaatggtgttttgatattaaaaggattacctctttatatatttaaagaggcaatcctggaaaaagaattatgaattacgtctgcctccgaatccggaacgacctgaagatcttccgcctccatgggaagcctgacctcccattctggctattcttgtacgttcagctttgctcatagatgcgaaacctcttcttgatgttcccgaacctgaatttgagccgcctcttcctgagctgctgccattatttcctgatcttgatgagcctcctcttcctgaaccagagttagaagatctgcctccaccatgtgaagcctgaccacccattctggcgattctggtacgctcagctttactcatagatgcgaaacctcttcttgaagtaccacttcctgatgatgacctgcccctacctcctgatctggagccggaaccagaatttgaacgtccacgggaaccaccaccggagtttcctccacgagatccgcctctaccggaagtaaatcttccctggctgtctctttgctggtttccgtttcctcctctggaacctcctcttcttccgccgctgcgtcctctctgatcatcatcgtcatcatcttcttcgtcatcgtagtcttcatcatcctcatcataatcatcgtcgtattcatcataatcatcttcatcataatcatcgtcataatcctcatcttcatcaaaataatcttcgtattccgaaaagtcatcatcgtaatcttcatctcttgaggcatcattaaaaccatgatcatagcctaactggtaaacttcttctaagttttccggtgaatgtgactgtcctcttgaactgcggtttcttgaatttctagtgttcataactgaattttttattattaatatttagtgatgtgtattgcagtccgtgactagtattagacggcaacaagttgggtgtcggtaattttaaaatgataataaaagcaaatgctttttatgttccttttactaaggtcttaagaattggattgaaaatttatatttcaaatgtacatcataataattcacttttttatgacctgaatcatgttaacgtagattaatacaaatttttctttttaaattctggttcttcagtcttgtgaagatttcctgagatgccggattcagcatcatattgtttgataattgcaggaatgattttatctttcatccaaaagtttttcaggaagtctggctcatcaaaaagacttccagacttttcctaattcaaaaaacatttcttataaagagttttactttttgctgagatattattatctgaaaatcttttgggtctgatgtattagtcttctgtacatcttgaacagaaggctttatcacattcactcagcttattatttcaatagtcttatggatttaataaaaaaaatcacaaaataatatacgaaactgtttctaatatagaattttgcgattttcaattctcacgattttatccttctccatatgtttgatggtccttattgcggtttctacacaaagaccggtaagactagccatctgctgcctcgttaatggaatcagaaatgaatatggacgtgcatctttctgaaagctcttcagataatccatcaagcctctaagcctaatagacggattttgagatgagagattctgcatcatgataaatttataataaaggcgctcagaaagaaaactgcttacttccatgcataattccggattccggttcagcagatttaaaaaaatggatttatgaagccttaaaacagtacattctgtaatagcctctgcattcatcggataaggcttatctatgaaaagtatagattcaccacagctttctccatcggataaaatgttttgaataaattctttcccttcttcattataattattaagttttatttcccccttaataatctggtaataatagttggggatgtccccttcaaagaatatagtttctgaagggctataatgtctcgtttctgctcccgctgaaatcaaaatattttcgtcgataaccataatagttgtttttggtgttgttttcttcttctcctcttctttagtcttagtaaaaatatcattgggaactgatggtagtatgtatgcaaaaattgcacctttatgattgtttatgaagttaaaaaaagttaaaaaaattaataaatgtaaacctattttgaattattggttaattatttttattaaaaattaatttaaattaaacttttgataccacattttgaagttgtaatttcaactacccgaaaaaatattagaaaataaaaacccgtttagtttgattaaaacgggttttttcaaaagaataacagaaaaaaccgttattttcttggagatttattgttagaggttcttgcagtatctgcgtgtttttttgtagaaactgtatccgtacgcattgtatctgcaggaaccggagccataggggtaacattggagacggtgtctgtcctcatcgtatcagagataacactatcagttgtaacggacgtttctgttctgttttcttttttacagctcaggacaatgactcccatgagcaggattgacataataaatttcataatagtatattttgtggtgatggttcaaaagtaggccattatgaatctgttttcttatgacttaaattataatgctttatttttcgttatttcgcaaattttttggttcctgcaacgcataaaattactcccactgtcactcccagcattcctaggcttacctgttcgtgaagaagccaggcagccaacgcaagaccaaagaaaggttgaagcagctgtaactgtcctacagtagcaataccgccctgcgccaggcctttataccagaatataaatccaataaacatgctgaaaagggagatataagccatcccgaaccatccctggaaactgacattaccgatatcatcaggaaaataaataaaaaataaaggaatcataacaggtaacgccaacaccaaagcccacgaaattacctgccagccgcctaatgtttttgaaagttttgcaccttctgcgtagcccataccgcataaaataacagcaagcagcatcaggacatcaccaataggcgaagcagatattccttgcgaaacggcatatcctatcactaaaagacttcctacaattgaaaaaagccaaaatacaggatgaggcctttcccctccacgcatcaccccgaatacagcagttaccaatggaagcattcccagaaatacaatagaatgcgccgaggtaagatattgaagagctaatgcagaaagaagtggaaaacctattacacagcccagggagaccagaagcagagggactaaatcttttttaacaggacgtttttccttccctatgcctaacactataaaagctaatactcccgccaccgctgcacggactatggttacaaagatcgggctcatttccatcactgccaacttggtagcgggcaatccgccactgaacagcagcactcctataaagccattaatccatccacttatattttcatcttttgataattgattggtcatcattttactaagcttttaattgattttccaaaattagaaaggataaacagataaacacagtaccagttttgtatatttgcatgagcacagttcaacattatgagtaaagaatatttatatacagaaattgcagacggcattgcgaggcagatcagaaatggggtcttaaaagccggagataagcttccttcggtaagaatgctgtgccaggaacatcaggtaagcatgaatacagccaagcgtgtttttctggaactggaatcacaatctttggtagaacccaagccgcaatccggttattttgtaagccagcttctctctgcaaagcttcctttgcctgaagtaagtcgtccgtcgctcattgccaataatgatgaaccggatgagctgatcagcaaagtatatgaaaatatggggaaaaacgatattacttttttctctatcggaattccgtcaggcgatcttttaccccaggcaaagctgaaaaaagaaatagtaaacgctaccagggaattaaaagatggcggaacggaatatgaagaacttcagggaaatctgaaactaagaagaatgattgccatacgttctttacagtggggaggaaacctgaatgaaaatgacctgatcactaccaacggcggaatgaatgccctttctttctgtttaatggccttaggaaaacccggagataccattgcgatcgaaagcccctgttatccaggaattctgcagctagccaacggactgggccttaaagtactggaacttcctacccatcccactaccggaatcgaaattgaagctttaaaaaaagtaattccccaaatcaatatctgtctccttattcccaatttcaactcacctttgggaagctgtatgcctgatgaaaataaaaaggaaattgtaaaaatactttctgaaaacaatattccactgatagaagatgatgtgtatggagatctttatttcgggtccagccgtccgaaatgctgtaaatcttttgataaagacggtaatgtactgtattgcagttccatctcaaaaactttagctccggggtatcgtgtgggctggattgctccgggaaaatataaagacaagattatgaagcttaaactccttcattctacctcatctatttcgatcgtgaatgaagcagtagctaatttcctgaaatccggcaaatatgaaaagcatcttcagcagctccgaaggacattgcagatcaattatcagaactatgttcagactatagcagaattctttccggaaggtaccaaaacgagccgtccgcagggaggattatcaatatggatagaatttgataaaaagataaaaacaacagaattatacgatctggccatcaagcagaacataagcatcgctcccggaagaatgttcaccttgcaggaacagtttgaaaactgcatgaggctctgcatagggcttccatggtcggaagatacacaggcaaagctgagacagattggacagcttgcccgaaagatttatttaaaggaaggaaggtagaggctggaagatggaagtgattttatttttaagaacagcttagaaggtgtaaatattaatcaccaggttcttcaatgtttaccaaaacttcaagcttccctcttccatcttccaactttttatttatccggaacgaaattttttctcgccagttcttttcttacacggctcaggctctcaggagtgatccccaggtaagaagcaatcatccattgcggaactctcagcagtaaatccggatacattttaatgaatttcatatacctttcttctgcagtttctcccagcagggaattgatcctgttctgaagacttctgatgtgtttctgaagaaggaaatcactcctctcaatactgttcggaaattgctctacaagcttattgaaaaaatcaggatgtaaaaacagaacttctgaatcttcaacagcttctatatagtaaatggatttttcattgaaataaagactgcttcggtccgatatcagccagctttccggagcaaactgtataatatgttcctttccgttcttatcaatagaatacattttcagcaggcccttttccacaaagaatatatgacggcatatttcgccatactgaagtaaaaactggtttttagggattttctttacttcgtaatgcagactgcaggtattcacgttctgaagcggaacatttaaaactttggctaaataattatttatattcttcatgacacaatctggcttaaggaaatatcctggtgtgaagcattgtttacagcttttccgttctcaattacaatcagctgcggactttcatgtctgatctcaaagtctgttgctattttgttggaaacaggtctgtgagccaaaagatccagataatatacattaaccggctgttctgaattctcaacctctttttcaaagtttttcaatacagtcctgctgataaagcaacttgtagaatgtttgaatatggctatcttcttctgaaaagaatcttctattgctctggcaagatcctcttcagattctatctttttccagaatgttttttgttcagggctttcactttttccaccgaatattttatcaaaaaaactcatacactaaattgttttagatggtgatcaagatgcttgtattctaaaaatgtccagtctttttcagtcatgcttccgaacaatctgtgacggcccggcagcttgttattacaacaaacttcccggaattcttccagcgttttcagcagattggcttttgattcatcaaaatcacactcaaaattaacgattagtttttgaaaagtaggcatgtttctgggaattccattattgaaaacatacatttctattttagtacagattcctatggtctcaaacaggatattgatacggggaaggtccagtttttccaaagctacctgaagaaccagatcacaatgtttcagcatctgacacacgttcatttttccccattttctttgggaattttcagataacatggaaattctgtccacaatttccttatagtatgtgggattattaagactctttcttaccaacctttttctatcttcagattttcaatatgggcaaaatggtgattacagtgccatacatataaagcaaggctctcccttagattatagtttttgttatgttcaggatgatgaaatgttctttcaaactgtttgttcgtaaggcttttaagaagaacaacccatctctggtgtgttcctttcagcattctcatagcagattttaccggcatatgaaaactatcctgaagctctgcccattttgcttcatcataaggttttatggtaggattatcttcagtaagggccagtttaaaacggataaagctgttcatatgactgtctgaaagatggttgacaagctgtctgacagtccagccgccttccctgtaaggagtatccagctgctcgtcggtaaaatgttcaatgagattttttagcctgccgggaaagtctttgataactttaatgtaagtgtccaatgtagtatcacaaatattttcaggggcttcaaactgccctattggaaactttttcttctctaaatcgctcattgctacggttttaatttttaaacagttcaggtttatccgattatatctttcaggacaacttttcagatatcacttgtgtaaatttatcaaaatttcaagaatataaaatgaataaagcattaattgtagcgataacaatttattgaacaatatatcttcattaaaaacggcctcagtgatgatactgggccgtttttagaaattatttttagaaattaataaccatgcagatcaattccttctgttctttgtaaagttactttcttacccattttcttttgaattactctgaaatgctgtaactcatcatcagtaagaatgctgattgccgttcccttttcattggcacggccggttcttccgatacggtgaatataatccaaaggagaacgtggcaattcataattgataacacatggcagggattcgatatgaattccacgaccgatcaaatctgtagcaaccagaatctgcgctccgtttactttaaattcttccagattatttcttcttgctccctgagacttctgactgtgaatagccactgccttaattttattctttttaagcttttccaccaggttatccgcagatcttgtagacgaaacgaagaccaaagctttttcaactttcttttctttgatcagataccgtaaaaaagggcctttattttcaggagcaacatggtaggccagctgctcaatattctcaatttcaacttcttcttttttaatttcaatgatgacaggattaatagacaacttctctttcatttcagccaccttatcatttagtgtagccgaaaacaaagtcgtttgttttacgacaggcatcagagcaaaaagtttattcatttcttccccaaaacctaactgaaacattttatccgcttcatcaattaccagatgccggattccggaaatactcaaagcattatggtcaatcaggtccaataaacgtccgggtgttgctatcagaacttccactccaaacatccccttcatctgtggatttatagaaaccccaccgtaaactgccattgtacggatctctcttttcagatttcctgtaaaagctttgaacacttcgtcaatctgaatcgctaattccctggtaggaactaatattaatacctgaatattccgtccttttttaacgtctgcattctgaagcttttctaaaatcggcatcacaaaacaagccgttttcccggaacctgtctgtgcaattcccataagatctttcccttgtaaaatcacaggtacagcctgctcttggatcgggaatggctttaaataccccagtttgttgacagaacgaataatattgtgtgataatcctaacgattcaaatgacataaaatatttatttcctgcaaagatacgctattgttatttggtttatctcttaaaatcctatacgtttcttacaaaaagaaattatcctgattgataatcccttcattttataaggggtaaaagtttatgttgccgatttgtccgataattcagttttggacaaatttttgtggattagttttgtaaatttatcaaaaattcgagaattcaaaatatgaaaaaagcgttaataatagtcgatgtacagaatgatttttgtgaaggcggagcacttgcggtccctggagccagcgaaattattccatatatcaatcttctgatggaggaaaatgaatatgaccagattgttctgacacaggactggcatcccgcgggtcataaaagctttgcaagcagtaatggaagaaaggtaggagaaagtattattttaaatggagttccacagtttatgtggccggatcactgcatccagggaactttcggtgcagagttccataaagatctgaacagagacaaagtaacccacatcgtacagaaaggcaaaaatattgaaatagacagctacagcggtttccaggataataatcattttatgaaaaccggtttggatgactttttaaaatatcatgacattcaattggtagaaatcgtagggttggcattagattattgtgtgaaatttactgcattggatgctgttgccaatggttatgtaacttgtctgcatttcaacggtacccgtgctgttaacgtaaaacctgacaatgccagggatgccatctatgaaatgattgaaaaaggagtaaccgttttagggtaattataaatgatgagttatgaattcttatattcatgccttaatataacaaaaaagcgcagaattatttcctgcgcttttttatttttatcctaaatcctttttgaaaaaatgatataagctgaaccctgaatctgttattcataattcataacttataattcatcattattttaaagcattttaagattgttcacttccagttctgtaaggattctccaatgtcctctcttgatgtttttcttcgttaagcctgcaaacatcactctgtccaaagcttccacttcgtaacctaatctttggaaaattcttctgataacacggttccatccgatgtggatttcaattcctacttcattctttggtttcccttcaatataagaaatctgatcaacaacagctacaccttcatcaagacgaataccttctgctataagacgtaaatcttcaccggtaagctttttatccaatgttacatgataaatctttttcgcatcaaaagatggatgcgtcagttttttcgtcatgtgtccgtcattagtcaataagataactcctgttgtagaacggtccagtcttccaaccggaaaaagtctgtaaggagaagcattggctacaagatccataactgtttttcttgctttgtcatcttttgtagtggaaatataaccttttggcttattcaaaagtacatatacaggtttttcaggcgtaatgctttgcccgtcaaaaactaccctgtctgttttctgtacctgatatcccatttcagttaccacctttccgtttacttctaccagcccctgggtaatcagctcatcagcttctcttctgctgcagatcccggaattagcgatatacttgttaagacggatgctgtctttatgaacatctttttcaattttgttcagtcttcttttctgtacaaaagatttcgctctgtcttcatttctttcatcaccattagatggtcttcttccgtatttcaggctgcctctttcgtacttatctcttgtatcaaaatttttcccgcctctcttaggttttccaaaagatttcttctcatagctctcacttttgttcgtgatataaggttttctttcagattttgaaccaaaatcatcattggaattttcgaaactgtcggtatttcttttgaaaggtttcttttcaaatcttgagttggatcctttatgttccggccctttttttcctccgtctttagagaaaggctttttaaaaggttttgatcctgaagaatttccagatctggaagcacgagaatcatcagaacttttcttggttgaaattcttggtctctttggtctgtctgaattattattatctctgctcattctaaaaatttctgcaaagatagtaatttagttacgagttaaaaattaagaatcataactttgcactatagtttacattttaactttacatactatagaagatgataacaatattaaacgataatttttcacagctcaacgagtttcttcacgagagatctttcagtaaaattttcattcttgtagatgaaaacacccatgaatactgtcttcctgttcttttaggaaatatggaaactgatcttggctttgaaattttagagattgaagccggagaggaaatgaaaaatatccagacagccaatcagctttgggaaattcttacggagatgaaagcagacagaaaagcattggttatcaaccttggtggcggtgtcattacggatatgggcggatttgttgcatctacttataaaagaggaattcagttcatcaatatccctactacccttttatccatgtgtgatgcttccataggaggaaaaacggggatcgatctgatgcattataaaaatatggtaggaacttttgcttttcctgagcagattttcattttccctaaattcctggaaacattaccatttaaagaattaagaagcggttttgctgaaatgctgaaacatggattaattgccgataaaaaccattgggaccaactgattcagatccgtaagctggaagtggacaccgtaattccgcatattcagacttcaatgcatattaagcagaatgttgtagatcaggatttccatgagcagaatatcagaaaaacacttaatttcggacatacgattggccacgctgtggaaagcctgtgtttacagcaggaaaatcctattcttcatggtgaagctgtagcaatgggaatgatcgctgaagctcatctggcatttcttgaaaaccttatttctgaagaagattcaaaattgatcattgaaaacatccagagatactacccatatcttgatatcagtgattttaaagatgaagatatcacagcattattactgaatgataaaaagaatacggacagtaaaatcaatttttccctgctttcaggaatcggttcttgtacctatgaccatcagtgcagccagaaaaacataattgaatcaatagctttttatagaaacctgaacgatgcttaactgtttttctgaaaaatatattagttttttaaaactattttgacaaaattgtcaatttagacactttctaaacaaatgtttattttcatttttaaaacactgtaaatcaacctgatagtttcaaaatcacttaaacactaagtgatttttttattgattttaatcataaaaaacttttttggcaagcaatttggaagatactctgcgttcagactgaaaatgttgaacaagtagtaaaatttaaaattaagaaagagtaaaattaaaaaattaaagttatgaaaaagttaattttaggattagcgttaactgcaggaacattcgcattcgctcaacagacaggaaatacatcttctaacccagtaacatttggtgtaaaaggaggaatgaacgtatcttcattatctaatggtgcagatctaagtgactctaaatcaaaaattggttttaatgcaggagtttttgctaatattccattagcgagttcttttagtgtacaaccggaagtaatttacaacgatttgggctcaaaagtaacaagagaatatactgtacttggaaataattataaaagtgaatattcaagaaatttagggtatgttgctgtaccagtaatgtttcagtataatgctacacctgaattcttccttgaagcaggacctgaattcggtttccttgtaagcgctaaagataagttaaagagctcaacaaacaatagcaacaatactcaggtcgcaactcttaacaaagatgacttccaaactttcaacttcggtatcggtattggtgcaggatattacttcattcctaatttaggaattacagcaagatatactgcaggtcttactgatatttataaaaacaactctggtgatgcggtaagaaacaatgtattccaggtaggattagcttataaattcaaataagcttatacattcaataacaaattttatattcaatagaaaagatcagattattttaatctggtcttttttttatgtatgattaatagcttgtctactttggcataacatttgatagttaaggaaacgttaaataaaacttaaaaactattaaataaaaacttatgaaaaagatttttttaggtcttgcattagtagcaggaactttcgcattctctcagaaaacttcagcttctgctgcttcaacttctcccgttagatttggattaaaagcaggtcttaatatttctaccatatctaacaataatgcaaattcaaaagcagggttttatggtggtgtttttgcaaacattccagtagcacaagacttctctgtacaaccagaagtattatatagtggacagggggctaaagctaaagctaacagtaatataaaacttaatacggattatattgcggtaccggtaatgttacaatacaatttgattcctaatctatatgtagaagcaggccctcaattcgctttccttatcagtgctaaaggaaaaggtaacggtgcaactgtagacgtgaaagatgattttaaaacttttgattttggtctagggttaggtgcaggttattatttcacacaaaatattggggtgaatgtaaggtatactgccggattaactaagattgctaaagaagatgatggtgattcttctaaaaatggagtattccaaattggtttagcttataaattctaataaaaaacttatatcagtacaaagccggatttaataaatccggcttttttgttttagaaatgattttggcaagaaatttgcgtattaagtactgattgtaccctagtccggaattccaacttacagttcctgttatacaataagtaagcgtaattcatttgttttaattcaactggatgtaaagctgaaacctaactattaccataaacttttaacgagaactgcatcggtttgtccgaaacaacagaatactgaaaagtattttgctcaacaatgaaaatacattttgatttcaatagaaaaagtcaggtttattagtttaagcctgactttttcgcttactgcgtgatttatatcacttttctcctttgtggcagatattttgctgcagaaatcagtttaaaactttaatcatgaaaaaggtattttcaggactggcattggccggatcacttttagtgaacgctcaggaaaaacaacagtcagtttcttcaaaatctcccgttacatttggtgttaaagcaggattcaatgcctctacacttagcactggtaaaactgataatgctgacaataaccacaagttaaagcttggctaccatatcggagtatttgtcaatattcctgttgcagaaaagttcagtgtacagccggaacttctttttagccaaatgggctccaaaacagaagggaaatatacctatggatctgctgtgggcaatcagtttataatacaggaattcaattataaaaccaatctgaactaccttgttctgccagtaatggttcaatatcgtatccttcctcaactttatgtagaagcaggaccggaattcgggcttcttctgggcggaaaagttgaaggagaccaaagagctcaaaatacttacaatggtacggtaagcatttataatgaaagcttttccaataaaatctcaatggacctttacaatagattcaattttgggatagaaatgggtgcaggatattattttacccggaactttggtgtcacagccagatttacagcaggtatcacagacatttttaagcatgattattataataataaggtaagaaataatgtactccagcttggagttgcttatcaatttaaatagagatattaattttcaaaaacgaatgccggcactaaattccggtattttttatgtccggccttaaaaacaatccaaaatatctcttttatttgtgtaaaaactctttcatttttttaatttttcattatttcaatgatcagcaataaagtattttttacattaaactcttttcatacataacgggtatagcagtacatttattcaataaaaagggataaatggttaaaaaaattcttttaaaaacccgctcccaaacccttataaacaggcctttttcaactttggcaagcaatttgcaaaataattcgggtctgattgaaatgatcgacacacaaatagtaaaattaaaaaataaaattatgaagaagttatttttaggattagcattaactgctggtgtattagcttttgctcaggaaacagaaacaaagacagagaccaatacagtaacagcatcgccactaaaaaaagatgttcaaccggttagattcggtattaaagcaggaggaaattcatcttacttcagcaagcagaaattcgggatcaactctcagcaattaggtttccacgcaggtgcattcgttaatattccaatttcaagacaattcagcttccagccagaggtattatacaatcaaatgggagcaaaagatgtgatttcatctacagaaacggataatggagttacaaatgtgaagactagagttgaggacagagtaaaaatgaactatatctcagttccgttaatggttcaaatgagacctgtagataatttttatattgaagcaggacctgaattcagttatttcatcaacgggaaaaataaaggagaatcaactgtagcaagcactacaggaggtgttacaaccactactacaagttctcactctacagatattgacaaagatcagatcaacagattcaatttcggattaggtcttggtttaggatatgatatcacaccgaacattggtatcaatgcaagatatgtgaacagccttacaaaaatcgataagagcagaccggcagctgaaaacaacaacagagtattccagttaggtctgaactataaattctaagtaaagaaccaattttttaaccctaagtgcattaaccagcacctataaaatcgccggaagaaatacttccggcgatttatattgtagcaaaatctgatatttattcaaatattctgggatcgtcactaataacgccatctatacccatatctttcaattcttttaatctttctttggtatttacggtccatgggattactttcatacccaatgcatgacattcctttatcaattgtggtgttacaagagtatgttcagggctgtaaatcgtaggagtaaaactcaggaaattcatatctccggctactccattcagatgatcgggatacatcttaaatttttccagaggaatatttttaaaataagcctgctgctgagccagttttttatcatctaccttttctacaagcaaagcagtcttgatttcaggatattctttatgaattatttccagtgttctgggatcaaaagactgaataatcaccctatcctgtattttcttttcaacaataatcttcatcatcagatcaacaaattctctaggctccggatgaaatatattgtctgagaagggacgcgttttggtttctatattataataaggtaacggtcttttcaattcacgggcgtatgcttcacaggcatctattacgtctgaaaaaagaggtttctgagccttcattttcttttgatcaggatatctgtcaagcttttttaagcctacatcaaaggttttaatcttcgcataaggcatttcataaattttgtaataaaaacctgaatcttttgggatataagttccatccggttttgtaaccagctccggcgaaagaaacacatcatgggaaagtattaccttcttgtctttcgtgatggccagatccatttccaatgtagtcacattcatttgtaaagcatttttcatggccgggattgtattttccggaaaaagagattttcctccgcggtgagcctgcttatcgaaagattgtgaaaagtaaaattgagccaccagcaggaaaacaccggttaaaaatatatttttcatatcctgaagttttaatctgacaaaattaaaactcctctgtatactgtataatatggcaatattaagcttttgctacatttataaagcaaaagaaccaggttgatacccggttctttttattatttcattaaagagattaattgaataaatctgtttcttctccttttcctacaggatattcttctgtaaagcatccgaagcagtgattagcagatcctaaaatttctttcaggttgtctatgctcaaaaactctaaagaatctaccccaaggtagtttttaagctcttctgtagacatatttgcagagatcagatcatctttggacggtgtatcaattccaaggtagcaaggagcaataattggcggagaaacacttctgaaatgaatctctttcacgcctgcatctttcaggatcttaaccagtctttttgatgttgtcccacgcacaatagaatcatcaatgatcacgactcttttatctttcatctcagagataatcgggttcagtttaaggttcactaccctttctctcatttcctgtgtaggaacgatgaagcttcttccgatatatctgtttttgatcagaaccgggcgaaaagggattccggaagtctttgaaaaaccaatggcagcagggactccagaatccggaactccaattaccaaatccgcttctacaggagcctgttcccagattttttcaccggatttttctctgatctcatatacattgatgttttcaagcgtagagtcaggtcttgcaaaatagatatattcaaaagagcagattctctgctttcctttcgtctcatccatcatataagaatgaagttttccaggctcgttttcattggtataaatgatctcgcctggaaggatatcacgtacatactgtgctcccacagcatctaaggcaacagattccgaagctacaacatacgatttctcatcaatagctcccaataccagcggacggataccattgaagtctctgaatgcaaagaatttgtttctcgtcattccaactacagaataagcaccttcaatcttttccatggttgctttgatagctccgcgaagacctaaatcaaggtttttctggatcagtctcaggataacttcagaatcggaagtcgctctgaaaacaacaccttcagcttccagttctgcttttaattcttttgcattggtaaggttaccattgtgtgctatagaaagtataatctggtcatattcgttttttgcgaaaaatggctgaaaattatatttctttttatctcctgcagtggtataacgggtatgaccaattgcagaatttcccataaaagtttcaggttcgtgaatgtctttataaacatccaaaacaagtccttcgtctttcatatttgtgattttcccttctttcaggacggaaataccacaggcttcctggcctctgtgctgcaaagcaaaaagcccgaactgtgaaagagagaatgtatccagatcactatccgaatacaatccgaagatcccacactcttcattaggagcatctagtctttcctcttcctgagttctgaaaagatttcttccgtaagtctgggtttcaaactgttttaaatattcacttttatgaatgtctaaacttttcatttctattttttctaatgattagaagttagatattagatattagaaattagtctaagttaacttcaattataattttaaacttgcttttaatgaatatatcattttttgaatttcagctaaaagttcctacaaaggaattattcctgaaattattttgcaagtaagtttttaagacggttatagatttccacataagcctcagtaacttctcccaggtctcttctgaatctgtctttgtctaatttcttcatggtatctttgtcccaaagtctgcaggtatcaggagagatttcatcagctaagatgatttcaccgtctgaagtttttcctaattcgattttgaaatctaccagaatgatattgattttgtcaaacagttcgataagaatgtcattgatatctgaagacagctcatacatttcgtcaagctcttcataagtagctgctcctaagaaaacggcatggtgatcattgataagcggatctcccagctcatcttttttatagcagatatcgaagatggttaccggagatttaattccttcttccactcctaatctttgtgccatgcttcctgcagaatagtttcttacaaccatttccaaaggaatgatagaaacttttcttaccagctgctctctttcgtctagttttttgatgaaatgagttttaatccctttttcatttaaatactcaaaaataagggtagtgattgcattgttcatttctcctttaaggtctacctgacctcttttttgagcgttaaatgctgtagcatcgtctttgaaacgtactactacttcatcaggattatcggttgcaaatacttgttttgctttcccctcgtacaacatttctttcttttgactcataattttactttctaaattgtagttagatttattgatttattttattattattcctgttaagacagccagtccaaaactcagcagtgtaccaatcagtacatactctgtgagctttctctgttttgcctgtgcaaggtcgctgaacctgaagacagatttggcagccaccatgaaacctacgccttcccagtgattcaccataataaaagtgaagaccataagacgttctaaaattcctatatattttccggcacttgataaagattcggtttgaatagtgttggggccatccggagcgggtgtccatgatgacaataaaattttgataaaaacagaagcaggtgttgtaagaaacaatgccgccatgattatctttaaaaattcctgattctgtaaaaatccgaaactgaattcccggaaataaaaagaaattccgccaatcactaaaatatgcagcagctggtcaataaaaaaccatcttttcttagtttttacattttgaaatataagcttggctgcatcaataataaagtgagtaaatcctaccagaacagctacccaccaaagctgaagatcccaaaggaaaataaggcttaaagcggtgtgtatcagaacgtgaaggtataaaaatttacttttcagtttatagttctccttatctgcaacccatgaatttggctgaagtgtaaaatctccgagtagatgtgccaatatgagtttgatgaagatcatgcttatagttctgagattttctttctgaaatactgattggtttccacgatgagctcatagttggctcgcttcagtctctggcttaccgaagactgtgaaatggcaaatctcttggcaagatcttcctgggtaatatcatggttcatgatcatttcatgaataatctctgctgtagccatggtccagttgtcaaaatccttggacgaccatttcaacagaatattaagatctctgtctactgaatcactggatgttttaatagcaacggtatgtccgtcacttttaagatcattcagcagtcttccggaattcacgtaagcagtaccattagattcagtaattttttcagaagagaaactttcttcaccaataccgatggccattcttacatctaaattttcaacacttttaataagagattttatggctagaaatcgccagaaaacgtcatcaatcctgcatttgaactgaaactcatcacccctgtagatttcccatgtgtgaggagcgcttccccatttttcgagaagatgtttaagcctggtaatccaaacttcagtgtccgcatgctgtgaatttataatatcaccggtaatgaccgctatcatactgcaaatataagcataattacttatatataaaaaatataagcagaaacccttatagatattgattattagcgaatctgcttatatcgatgatgcagtaaacataaggtttttaaggcgttatatcaaatctgaaaattgggaaaaagcaaaaaaataagtaaatttttacagttacatttactttaactctacttttttcaagtttttttaacgagaagcttattcctgctatccgctcatactcctcgctcctgcctatccctcgctctttaccctccagctcttcccactcacgctccggggtaaccgctgctatcagggctaaaaaagtcagtgtgagcaaaacaaagcgatcttatcaatttcccttatgtcttattaaaaataaacctaacaggtttgatagcatttaaatctgatttcatttactttttaataaactgatgtgccttttcatcaagctttaagaagtaaattccagttggaatatcttgcacagcaatatctttcttatgtctaaaaggatctttttcggtataaatcacttttcctgaaagatctatgatctgggccgtttttattttgtcagtttctccggttacataaagatgatcatcaaccggattgggatagatagtaaattcattatgatcagcaatcaattctgaggttgacagtgtgccgagattctgacagtaattggatggataagaatcccattcgccgatagtaaatgtgctggtaggctggttgatggtattctttctgtataaagatacattaccgttattattaatggtgtattttaccccgatagcatctaccgtaactgttttattataagcaagctctacataattttcccctgcaaacatcatggggtcagatgctgttacaaattttgcctgatcaggagtgtagcatgacagggttccttttggattcagaataacaaaagtttcattgtttcctactttcccttccaactcataggtatctccattatagatcgctccggtgtttgtatttttgaactggatgttgattctgtaattattcagattaacctcatgtcctgttttattaacaatttcaagtgcattattcttaatgaattctgtattcgttccggaaatatatttggtgatcataagatccggtgcataggtatccgaagcaatggttgaagctgtaacagtagtactgaaaggcgattccagatatcctttatcaaaagctttcaccgtaaaagtataagttgttgacgggctcagatgatctatgctgacagaagtcccttttgtaaccgcaacaggtgtcgttgatccattcatatacacccgatatcctaaaacatccgtgtcaggagaagcagtccagctcagattgataaaatgagcattctgctgtgtagaagccagtgatcccggtgctgcgggaggaatattgtcgggagattcagaccagatcatatcgatccattcaggatggtcaataaatggatttctgttcttttgtatagtataaatggtattattccggtcaatttccctttgtgaaaccggatctgcagcactccactgtttcagcattgcaatataggcaagatcaatagctctttcctcagttccatccagcggacattggtctgtagcaggtgtgatggtcgatgatgtgctgtaagctgtattaaatgacccgagttttccttcatatctcacagcgaaatacagcagcgttcttgcaatatcacctttgaactcattaatgggttcgtaaacccttccggtatacggataattgggaatcgcagcattggccattctggaaccattggtgaaattatagaaattggtattaccacctattccataaggataattgtttctcagctgattgatccttgcatcagccggaataataaagttaagatcagaatacataggataatcgctgatggatgagcttgtactgaatgtactttgcggcatcatatgctcccggttgtatcccataccttccatactgccattaccgatgagttgatttactttatactcataagcatccgggccggttggtatttcagaataaatatccagcagatattcggtattggaggcatcatgatcataatatttatcaagatcagtctgcccatacagtcccggaaggtcattgtagtgccagttaatcattttttccgaaatgatatcatgaagttttgatttcagggcataccccgttaatccggcagtaccatcataatatccggcaggagcctgcgcggaaatataagaggaaattaaaataacaggaagtagaatttttttcataccgtaaaattgggcaactaaaatagtgaaattaaaaattcaggaaacccaatatttgattaagaaagtattaattctcacacataaaaaattgaaaactaagagcattacccctgataaaataatttgttttggcattccatcaatttggttatctttgggaactaactattattatatgaatactgagactattgacaacattaaaatgatagcggagacggctagagaatttgcagaaaagaacatcagaccgaatattatggaatgggatgaaagccagacttttccaaaagacttattccaccaactaggtgagatgggctttatgggaatcgtagttcctgaacaatatggaggttccggattaggttatcacgaatatgttgctattctggacgaaatttctcaggttgatccctctattggtctttctgtagcagcacacaattcactttgtaccaatcatatctatgaatttggaaatgaagaacagagacataaatggcttcctcagctggcttccggaaaagtaatcggagcctggggacttacagaacacaatacgggttcagattcaggagggatgtctactaccgctgtaagagacggtgacgagtggatcatcaacggagctaaaaatttcattacacacgctatttcgggagatattgctgtagtaatgacgagaacaggagagaaaggagctaaaaataattctacagcctttgttttagaaaaaggtatgcccggatttacttcaggaaaaaaagaaaataaactgggaatgcgtgcttccgaaacagcagaactgatctttgataatgtacgtgtaccggattctcaccgcctaggtgaagtaggtgaaggtttcaaacaggctatgaaagttttggacggaggtaggatttctattgccgcattaagcttaggtaccgcaagaggagcttacaaagcggctttgaaatacgcaaaagagagacatcagtttggaaaaccaattgcagacttccaggctatcaactttatgctggctgatatggctacagaaattgatgctgctgaacttcttatccaaagagcttctacccttaagaatgcaaaacaaaaaatgacaaaagaaggagctatggcaaaattatatgcttctgaagcttgcgtaagaatctctaataatgctgtccagatcttcggaggctacggatacacaaaagacttccctgctgagaagttctacagagactctaagctttgcaccattggtgaaggtacttctgagatccagagactggtaattggaagagatatcacgaaataatttcaaatcccgatacaaatgattaaacaggcacttttaggtgagtttctgcacgaagccgaaaacaccagaaaaattttacaggcaatccctgacagcgcactagactggaaaccctctgaaaaaaactggaccaccggtcagctggcttcccacattgcagaagtatacaactggtatgagcccactttcaatcaggatatttttgatatgggcgcttacaggtatgataaaggagatatttccagagcggaaaatatccttgcaaaatttgaggaaaatgttgccaatgcacagaaagctctagaaaactctgacgaaaagacctatttcaacgagtggaaaatggaaatggacggaaatgtacttttccctcctatgcccaaagttcaggtgataagagcttttctttataaccatttgtatcatcacagaggtgaactggttgtttatttaagatcaaccggaaataaagttcccggactttatggacctaccgctgatgataaaatgtaattaaaaattgaataaatagaaaaagctgtttcattttgaaacagctttttttgtcaataaatataatgtagtaaatcgactttcaacaaatttaattaactgatattgctctaaaaattgaataatcatcaatatatattgtctcattttaataaattaataaataaaacacatttatatgaattaaaattgaatttatcgttttcgcttttcttttattaatgagctttttcaattatatataatgtatcgcatagtatattatgttcaaagtctaaattttccttaaaaaattttgttttccataatatattttttattagatttgatattccacaatcaaatttaatatttaatatgaaaaaacaattaacgctgattggaatgctccttgtttcgggtatttctttcgcacagactgaccgtctttggactgaaggttccagaaaagcttcatcagagatctttgaaaacaaaaacagcatcaacaatcctaaggtttacaacctggatatcaacggattgaaaaatgctctgtcaaaagctcccaaaagactggctgcaggcgaaaaatcagaactcattatctcttttccgaattctgaaggcagaatggaaaatttcaaagtgagggagaattccaattttgcccctgagttggcagcaaaatatccggatatcaagtcctatgtaggacaaggtctggatgatcctaattccacagtctatttcagtgtttctccactcggactgtcatcaatggaaatttacggcgataaatcagctgtattcattgagccatacacaaaagacctttcctcctatgttgtgtacagaaaatctgataaaaaggatgatcttaacaaatttgaatgtacagtagtagaagccgcacagaaaggagtttcaaattcctcactcgcagcaagacctaatgctgacgatgccaagctgagaacattcagacttgcgctttcctgtacaggtgaatacactacgtactttggaggtaccaaagcacaggctctggctgcaatgaacaatacgatgacccgtgtaaacggtgtttttgaaaaagattttgcagcaagaatggttcttatcgccaacaatgactctgtaatttacaccaacgcttctacagacccttattctgcagcctcaggaatgagcaactggaattctcagttacaaagtactctaacttctgtcattggtgaagcaaattacgatatcggacacctgttcggtgcttcaggtggcggtggaaatgcgggatgtatcggctgtatctgtacgaacggatcaaaaggaagcggatacacttctccggctgatgctattccttcaggggataattttgatatcgactatgtagctcacgagatgggacatcagtttggtggtaatcacacgttctccatgagcaacgaaggcacaggtgctaatatggaaccgggatcaggatcaaccatcatgggatatgcaggaattacaagccaggatatccagcctcattccgatgcattcttccatgcgataagcattcagcagattaccaataatattaaagctaaaacctgttctgtcaataccaatacaggaaactcaattcctactgccaatgcaggtttagactataccattccaaaaggaactccatttgtactgacaggtaccggaacggatgccgacggagattctttaacatatatctgggaacagatggacaacgcctcttcttctcagacaggagcaagttcggcagctagtgcaacaaaagcttcagggcctaacttcagatcatggactccaacaacagtgcctgtaagatatttcccaagaatggcttctatcctgacaggtgcaaccacaacagcaggctctgaaatcactgtagaggcgctttcttctgttgcaagaacattaaacttcagatttaccgttcgtgacaacaaagcaggaggttcaggaaataattctgatgatgctgttatcacagttaattccactgcaggaccatttctggtaacttcacaaaactcagctacaacatatgccggaggaagttcccaaactgtaacctgggatgtagcaggaactactgcaaacggagtaaatacagccaatgtagatatcttatggtcaacagacagtggaaatacatggactacactgttggcaggaacccctaatgacggttcacaggctgtaacgattcctaatgcaaatactactacaggaagaattatggtaaaaggatcaaaccacattttctttgatgtcaacaatgccaacatttctgtaaatgcaggttccggaactcctgataccgttgctcctacagctcctacccttgctgcttcaggaacaacttctacaacaaccaacctttcatggtctggtgctacagataatgtaggagttacaggatatgatgtatatcaggggacttcattaatcggttcaacggcttctacaacgtataccgtaacaggacttactccttcaactacctactctttctcagtgaaagcaaaagatgcagcaggaaatgcttctgtttccagtaatacagtaagcgttaccactctttcaggcggaacggttacttactgttcttcttcagcatccaataccgctgatgaaagaatcggaaatgtaacattcggatctattaataatacttctacaggaactgcaggttatgaaaactttacttcagtttctacgaatgttacaagaggaaatgcctatacaatttccatcactccggtttggacttctacaaaatatagcgaagcatatgctgtttatattgattacaacggtgacggagactttacagacagtggagaactggcatggacaaaagcaggttctacaaccagccctgtaacaggatctatcacaattccatcaacagcaactgtcggttctacaagaatgagagtaatgatgaaatacagctctatccctacatcatcttgtgaagcatttacttatgggcaggttgaggattacacgcttaacattgtatcttcaggaaaaggagatattcagaataccaaagatctgatcacagatgtgaagctttatccaaaccctgtaagagatatactttacatttccaatacagcttcagaagattataaaatcttcgatatgggtggaaaactaattgactcaggaaaacttcagagaggttctgtaaacgtaagcaatcttatcaaaggtgcttatatgattcaaatcggagaatattctaagagatttattaaaaattaataactttaaaattaaacgatgtgaaaaactgcccttcggggcagttttatttttaatgtaaatattacatgaaaaacatttatgcctgttattaattttacataattattttaggtgattatatatttctttacactaatttgttaaaataaaaaagagagcaactattgctctcttaaatttttataattacttttgattttaggtttacatctcgtatcaataccctaggcgaaaaggagaagcgccgaaggtgacacggtgatggttgtcatcattaaaacttgtaatatcatggcctcgaaacctaacaacaagttcgtaaaagttcacaaaccaacgaaagatggcagagggttcttttacagaagcaaacccaaaagttgccctaaaaagtaacaattggtagcaggggcaaccctgcttttttatttctatgtaaatgtaaaactattacttcacattaccaaaaaccttgattctaaaattaagatttaggcttatgattccaaactttagtaatcatattatcaaagtctgttttcacatgtatgtattctgccatgattaaaggaattttctcatgatacttaattttcaatgtctcaatctttaattcagggcaattgctttttatatcttcaacataaaagtattcttcaccatttaaaataatggttcttacttctctttgttttaataacacttctttcatttatcctgttaaatctttgtatctggttctcacattattgttattcaataagtgttcaaactttttatagtctgtgatttctcttaaattatacctatacacaaattcatcaacatatttttgaagatgcttttttgaaacgtgattatacattcctgaaacacttcttttcagaatgttccaacttccttctatgttgtttgtgtgtactgtattatcttgcaaacttacatattcttttttagaatgatctataattcgatgatcgtaatgtctatgcaatcctctataagcccaccattcatctgaaatgagtcttgtacctgtttttacatatttatgtattaaaggctgaatactttttctctttgtatcagtcactacaaacgcattcaacttcccatctctttgtagcatacccattacaggaactttgtctttaaaacttctaccttgtgagtgtggaactttcttgtctttgtgtctattcttgttttttcctccaataaaagtttcatctgcttctacaattccatcaagttcattacagttttctatcccaaaacaagctctgattctttgtaaaacaaaccatgcagtcttttgggttactccaatatcttttgctaattgcatagaactaatccctttcttatgtgctgtaacaagccatatagctaagaaccattttctaagactaacctttgaattttcaaacattgtcccagtcttaatattaaaatactttcttgtattcttacatctgtatctgttgtttttgcatttgtaaacttttgaagttgcatcaaaaggactaacaacaataccagtccaaataatttcctccaaatagtctatgcaagcctgttcagttggaaaggcttgtattaattctaatactgattttatgttggtgttaatgaacatatattagtctgttacgtttttaataattgtattaacagcatcataaagccaattaacattaccattataaatagtctgcatattggagtttactgtttgagtaaagtcgtttaagatcttttcttttttagtctcagaaacatctaaggattttatttgacctacaatatcatctattactgcctgagcattcttttgattattattgtatctattctgtaaagtagttgctgcattgcccaaactagaaatatctaatttttcaggatctctatattgatacggctttctttgttgagcttgatctactctgtaatattcccactgtttcgataaggaattaaactttttgaaagctattagattaccataagaatctatataatcatatctaccataagtagaattgtatttctcagtaatagtttgagaaaaacaaaatgctccaaataaaagcataattgaaaagaaaatttttttcataagtgaatttgataatccactcaaacccaaagcagaaattttaagattataaataaagaaaggcgtgggtttgtagtctttatttattacctgtggctctggattgccaaatgacataaacaagacaacccacacccatataggatgtaagtgtctaactgtttattctgtgtcattttaagaaattttccagatttcaggtaacagaataaaagctaacgcttcctttttaatcgataaatattcctacaaaagtacaaaaattatacctttttcactatatttggagaaactaaaaatcaaaaaactatggatccaacagcgtatcacaatcacaaggcaaatttcaatagattgacaggtaaaaatgctgatgaagagttagctgcttttttcagctatcttaatatgttaaatctatttgatattaaagatcttttaaaagatctgagaattatgataaaaaatgtagaaactaatactaagaattagaacttagcaccctatcttttaagggtaattctcctgtagttatccaatcataattttcattagcattttgaatatttccctttgctaaaattaggcacaataatctcaattgtgcttctgtaaaatttttcattttgtaaatttttaaattgttattaaataaaaaagaccaatctaaatattagttggtctttatttttttctatgtttgtgtaaacttatatatagttaccttattttatttaaaataaaaaatcaccagtatttgagttttttgatttaaatttatcaaataatattctattgtaccgtttgcccagtttgtatttaagggagctccgaaactgtttttaacatctgacaccgttgcttcttttgactctgttttgggatcatttagtacttgaacaattccggttcttaaatccagttatattgactgcaaagtattaccgctttcaccttagcatttccacttatggcatatgtaaagaaataatgtttcaaaaaggtagtcccctttaataccttaataattttaaaataatttaatttttttatatgaaacatttatttaagtacttttttatcttaacgatcaccactttctccgtcgcctgtagctctgacagggatgatgaaccagaatccaattctgatgtcaccattgtattctataaaaatgctgatgaactcgcagcaacttacgatccgaataacagtgtaagccagtctgtaagaaatcaggcctacgatctttacaaacagggtaaatggagcgaactggaagcacttttcaaagcaaacaatttaaatggtggatggcctcctgccaacggcggttacaatatcgttgatgatgttccgctacaggttggacagaaatttgacagatacagcggagctgtgggcaattataccggcaatggcgtccctactttaggcggaagttttaccagtccgattattaacggatatacctatacttttacgcaaagagccttaaatcagcctgaagacaaatatgatttttattatgaaattgatgtcctgaataattcaatgcagtttaaaacccagaccgcagatattattccatggtttggccaggctggaaaaggaaaacaaaccatgtggaaaattccgattgatatcaataccggttatcagaaaacatggaataagcttgcagaagaaggctatataaaagttaccattaagaaaagtcccagcggaaaatataataacttagcaggcacagttattcagccataaatcagctcaaatgtattcaatatcagaaaaaataagcattaccggaaaagcttctgttgaaaaaagctctttcatgaatgatgaagctctgccttcggcaataaccactttcagctgctgtgattgcgggaacaaaaattcaattgcaatagctccctatgaatccgggtttcccatccttcagctttaccatgaagataaagtagtatccaaagacgaattgttgaaaaatggaatggtcaacagaacctctcaaagagtgcttcatttcggagaattcaccgttaatgatcttccgactttatattttggcaccgattgtacttcctgtcgctcaaagtatatctgtatattcagctatggagaaaagcagccgggcctggaaatattaacgatttccggtatctggaaatacgaataactgaaatcatttctattaatattataaaagtctacaactttaaagttgtagactttttcttaacttagcagacaaactaatttcaaccatgaagcacgtctacaaatgagaaaaatagccctatttctttttgccctatgctttggatcagtattttcacaaaaaacactctctaaatatcctgaaggtcagttcccttataaagaaggacctgtccaaatgtctgcagacatgcagaactattttctgaaaagcggtgcaaaaccttgtgataaaaacgagatgtattttgtaaccttaaaaattgataacaccggtaaaccttctttggtaaagaaaaagagtgatgatgctattatagaaaaaaataaatgtgcattcgatctcgccatcaagtctataggaagcctgaaaaactggcatcctgcggaagaaaacggagaaaaagccattgcttattttgatttccctttttttccacaagacttttttgaaaattataaatccgattacgacctttcaaaactataccaatatcctgacctgcctggcggatcgcatgagttgagaaaagaaatccataaaaaactggaaggatatttagatcctacatcctatagtgcgaacggaaaatttattatttctttcatcatagatacggacggcagtatttctactgtagatatcgaacctaaaatagataatagtgaacagttttttgaggatattaaatttattttgaaaaaaattaaagtaaaatggaatcccggaaaaattaaaggacaacctataaaatcaaaattcagaatgccattcaattttaaatcaagagatttagattaagattctcgaaaagcagttcttttgtactttgcattttatccctgtatatttcacattttacaaatccttttctatctttgtgggaaataaaaaattcatggataaaattgatagtctgaaccaagtagcagaattccatactactttcaaagcccctattttagataccccacaaattccttctccggaaagatgcaatctcagagtagaacttttacaggaagaacttaatgagttaaaacaggcaattgctgataacaatattgtagaaattgcagatgcactttgtgatttacagtatgttttaagtggtgctgtgctggaattcggacttggcaacaaatttgtagagctattcaacgaagttcagcgttccaatatgtcgaaagcatgtgataatgaagagcaggcaaaagaaacagttgaattttataaggaaaaggaagtagaatctttctatgaaaaatccggagaaaaatttaatgtttacagacaggcagatcataaagtattaaaaaacaaatactactctcctgctgatttaaaatcaattatcgaaaaataaaatatgaaaaaatttattaccaatattgttgccgtttcaagcttgtttttagctgcacaacagctcagcgctcaaaaagtagtggtaaaccgcgaggttgaaactcagaatgacggcaaaatgcttttgggaaaccaactgaaggagcagtttttaaaagcgccttacgcagattggtacgtaaaggaacatgatgaatatgcccttgaccaaaaagcagtcagtgaattaaaaaaagagaaaatcgggtcttatgatatcattgttttcatgggaacatggtgtgaagacagccacagagattttcctagactgatgaaaatattggaagccgtaaattatccggaaaataaactgactatcattgccgtaaaccgcaaaaaagagtctccaaccggggatgaaagcctttacaatcttcagaaagttcctaccattattctgaaaagatatggtaaagaggttggaagaattatagaaatgcctaccaccggatatattgaaagagatttagttcaaattttgaaaaagaacgattcgtctgttatcaaagaaatttttaaatagattttgagaaattatagaaccatattatcctttgcagccggtgccggcgctatggtacttctgttctttggactgaagtcctgcctgaacctcggaaataaaacggaacagtcggattattatatcctgaccaaccagatttccaagatgaataaaatggtcgtattggaacaaaatacttccagcatgcagaaaaccaaaatgggttatgaagtttttggaaaagaaatctccagcaacagtattatcacctataccaaaacgaatgcacaggtttcctacgatcttaataaaatgaagattgaggtagattctatcaataaaaaactggtgattaccgagcttcctgatgctgagataagaattacgccaagcgttgagatccaatctctggatgattctttcattaacaggatttcggaaaaggatattaaaaatgttacagcaaaagctaaggaaacagcagaaaaatcaattgaccagaatcagctgagaaatgaaggccggaaacaattgatggaaaacctgaataatatttttgttttggcaaaagccctgaattataccatagaggataaaaccggtaaaattggtattttgggactgtagaatgaaatttttccgtttggcaaaccctttgaataataatttacatgttcttggaacttaaaatgtaaagtcatggatacaaaaggaaacaccaaaaagaaagaatctgccaatacagcagagaccaaaaaacaaaatcaggattttcagaatattcctgcagcatcaaaaaagaccaatccacctgatattgataaagaagatatccggaaatcatcaaagaacaaatcaggaaaaacggataatacaaaagacaaaaagcaataagacttttataattgaaaagttccgtctcatgcgaggcggaacttttcgttctaactatctaactgaacttttattttctatacaatggtggatttcccgatctttacattttcaaaattataatatgacgtttcggaatatctgatatggtctgcaataaagcttcccacttcacttgttgagtaatattgtttcgtattaagatcaacagtgacgtatttattttcaatagcatgttctactgattgtctcaatttgtcggctgcggcctgtaaattaagatgatccagcatcatagccacacttaaaatagaagccacaggattggcaatgccttttcctttagcctgaggataagatccatgaataggctcaaacagggcattcttctctcctactgaagcagatggcaacaacccgatagaaccaccgatcacacttgcttcatctgaaataatatctccaaacatattttccgttaaaataacatcaaaatgcttaggattaagaatcagctgcatggcggcattgtctacaaacatataatcaagctctacatcaggatattcaggagcaatttcctggcatgtttttctccataatctcgaagtatccagaacattcgctttatcaataagcgtaagtttcttctttcttttctgagcttcctgaaatgccatatgtgcaatcggaataatatcttcacggctgtatttgcagacatcataggcgtaattaccttccggatctgtaaatttttcaccaaaataaattccgcttaccagttccctgaaaatctggatatcagctccttcaataatttctctcttcagcggactcttatcaatcaatgacggataggtcttcaacggacggatattggcaaacaatcccagctctttacgaagttttaataatccctgttcaggtcttacttttgcttccggattgttatcaaacaccggatcgccgatagctccgaaaagtacagcatctgattctttacatatctttaaggtctcttcaggcagaggatttcctgtcttaaaaatagcttctgcaccgattaatccgtagtcaaaatgaaatttacattgaaaaacttcagcaatagtatctaatatcttaatgctctcaccgataatttccgggccaatcccatctccgggaagaaccgcgattttaaaataattgtcgttcatttgttttttgtgtttttagttcgaattctgtaatggctttttttctgctgattaagaaatcaatatcatcataaccgttcagcaggcatatttttttataagagtccagttcaaaggtttctgtggtatctttgaaactgacagactgtaattccacatcaatagcaatttcctgatcaggattttcattgattccttctaaaatttcttttaaaaatccttcggaaacctttacaggaagaagtccgttattcagggcgtttcctttgaaaatatcggcaaaataacttgaaatgataactttaaatccataatctgttaatgcccaagccgcatgctccctgctgcttccgcagccgaaattatttccggcgacaagaatttcaccactgaacttaggattgtttaaaacaaaatcaggattcggttctcctgtatgaatattgaacctccagtctctgaacagattctctccgaaaccctttcggtctatacttttaagaaatcttgcaggaataatctgatctgtatctatattttctgccggtaacggaaccgcagtggattttataataactaatttttgcatgtacttttagtgggtttagtttaaactttcaaaagctgaaattttaccttctatagctgcttttgctgcggtgagcggactggcaagaattgttcttgcgccttgtccctgtctgccttcaaagtttctgttggaagtggaaacacagtattctccttccggaatcttgtcatcattcattgccagacatgcggagcatcccggctgacggatctgaaaacctgcatcattaaagattttatccagtccttcctcataaatctgtttcaccacctgctgggatcccggaacaatcaatgcttttaccgcttccgctttgcttttgcctttgatatattgagctgcagaacggaaatcttctatccttgcattggtacagcttcctataaaaacataattaaccttgatactgttaaccgcttgtccggcttccagccccatatattgtaatgccttctcttcagattcattctgcggcgcaggaataacttcacggattgaaatacccatgcccgggttggttccataagtaatcatcggataaatatctgatgcatcaaagctcagttctttatcaaatactgccccttcatctgttttcaaagtcttccagtattctactttttcttcccattcttctcctaccggcgcgaattttcttccttttacgtattcaaaggtggtttcatcgggagcaatcattcctcctctggcacccatttcaatactcatattgcacacggtcattcttccttccatcgacatctcttcaaatacatttcctgcatattcacagaaatatccggttcctccgtctgttcctatctttgaaatgatatacagaatcacatctttaggctgaacattttcgtttaatttgccattgactgtaattctcattgattttggcttattaagcaacaggcactgacttgcaaatacctgtgccacctggcttgttcctattccaaaagcaatagttccaaatgctccgtgggtagacgtatgactgtcaccgcaaacaatactcattcccggctgggtaatccccagctccggagcgatgatatgtacgattccctgatactgatgccctaatccgaaaagttcgatattatttttcttacagttttccgtaagctgttctacctgatttcttgaaagttcatctctgataggctgctcctgatgcaaagtgggtacattatgatccgcggtggcaacaatctgttccggtctgaatatttccagatttctggattccagttctgcaaaagcctgaggactggttacctcatgaatgagatgtttgtctatataaatgatctgaggtccgtcaggaatggtttctaccacgtgcgcgtcccaaactttatcaaaaagtgtctttttactgttgttcattgtttactttatcttgattttaaatcaaacctatcctatttttctggcaaaagaatgcatcatcatgttcaggtcctcattgtctatttcttttttaaggtcggcgatcttcagaaattcctggtacaggtaatcaagttcattcttggtaacttcatacccgatatgcttaaaacgatatgccagtgccgagcggccgcttctggctgtaaggataatggaagaggcattcactcctacttctgcgggatcaatgatttcataggtttccctgtttttgattacaccatcctgatgaattcccgaactgtgggcaaaagcattggctcctacaatagctttgttaggctgtactgccattcccatcagatcggataccatggcactcatttcattcagcattcttgaattgacattggtatgcagattcaggtctttatgctgttttaaaatcattacaacttcttccaatgctgtattaccggctctttctcccaatccgttgatggtacattcaatctggcgtgctccgttaattgccccggcaatagaattggcagtagccagtcccagatcattatgacaatggcaagacaataccgctttttcaattccctttacattttctttcaggtattttattttctggccgtattcttccggcagacaatatcctgttgtatcaggaatattcagcactgtagctccggctttgataacagcttcacaaacccttgcaagatattcattatccgttcttcctgcatcttcagcatagaattctacatcttccacataggttttggcatatttcacagcttctgccgctctttcaataatgtcttctcttgttgagttgaatttatatttaatatgagaatctgaagttccgataccggtatgaattcttggtctttttgcaaatttcaatgcttctgctgccgtatcaatatcttttttattggctcttgtcaatccgcataccttagcatttcttaccagttttgaaatttctgaaaccgattcaaaatctcccggactggaaatcggaaaccctgcttcaatgatatcaatccccagctcatcaagcttttcagcaataaccagtttctgttccgtattcagtttacatcccggaacctgttccccgtctctcagtgtcgtatcaaaaatttcaattttttcggaattcataaatgaagttttttacttaattttgattcaaaactacagcttgcaatattttttcattttcacattttttgaaaattacaatattcaacagttgaaaaaacaatcttatttacctattaatcaataatttaatttataaaaatttacaatggcagaattgcagaaagattttttgtttgtattggtaaagtcattgactacttctgaaaagcgacagtttaagctgtatgtaaaccgtctcggaattaatgttgatgctaaatttcttctgctcttttctgagatggataaaatgaaggaatatgatgaaacagtgattattgagaaaaaaatttctaccaaacaacagctttccaaccttaaagcccatctttacaaacagattctggtaagcctccgtatgaacccgagtcatcagaattatagaattcagcttcgggaacagctggattttgccaatattctgtatcagaaaggcctttataagcaggctttaaaaatattagataagactaaacagactgcactggaactggatgaaaaaagtattgcttccgaaatcattgatctcgagaaagtaattgaatcacaatttattacacgaagtatcgaaggccgtgctgaagagcttatcaaacagtctcaggagatcagtaagcaaaaccgctacacgacaaaactttccaacctttcgttgaaattatatagtgaaatgcttacccatggttatgtaaaaaatgatacagaccgacaggaagttatggatattttcaatgctgaaattaaaaatatcaatcccgaaaaactgaatttcactgaaaaattatggtattataaagcccatgtatggaagaaccagctattacaggattataaatacactctgaaatatgcttatcagtgggtagacctctttcataagaagcccgaaatgatttacagccatcccgtctggtatattaaaggaaacacttatctgctcaagatcctttttctgtatggaaatattgacattctggaggagcattttgagaattttaataaaatggtacatgctgagaactttgttcagaatgaaaatcttcagtcccttattttccttacccagtacaataccctgatgaatattcactttgtgaaaggagaattttttaccggtaccaaacttattcctgaagtggaattgaaaatggaaaaactcagggaaagaattgatgagcaccattttatgattctttaccttaaaatggcggccatgttttttggcagtaaaatgtttgaaaaatcaattgagtattctatgagagtcatagaatccaaaggtaatgtacaggaggatctgctgttccatacgagaattctgatcttaatggcaaaatatgaatccgggaatgatgaagattatgatgaatttattgcttctactttgaagtttgctaagaaaatgaagaaaccggaagagttccattttgaaagcattcagttttttaagaatcttaataatcaggtgccggatcagagacagaaagcctttgaaaattttgataaaaagctggaagaattttcgaaaaatgaatattacagacgttcattattctatattgacatccatggatggatcaagtctaaagtccagaatgtagatgtgattgaaattatcaagcagaaagtaaggtataaaagaaaacattaaacaatatcaattaacaatctgtttttaaacatattaaagcatgttatttaatgtaaaataaaacagtaaaaaaatcccgcagatttagcttattatcacagataaatataaaatctgtttcaatttccaaatctgcaggatcataaaatcatattaactgtattctactcatacatattctcaataaaattaagggcatttctatggctgattttttctgccagctcagatgaaaaacgtttttcaatttctttattaattgcagaatatcccgaagcattggaatgttcaggaaagaaaaaaggatggcgggatgtatccggatgatccttccaataaaaatagtctgcaccgtaagccatactgttttctccgccaagatctaacccgtattggatatgctcgtaaattctatccgggttttccgtatctacataatccttgataaaattcagcccgatcaggccttttcttctgatgacttcctttgcaagttcatcaggaagattcctgttgttctgataaacagacctgtagttggaatggctcgccagaaccggaattgaatagtttctctgatcaatataagtaaaaatatcatgggccagctgatcacttgtatgggccagatcaatagcaatattacggccagcaatataatcaatcagaactttcccgtcttcctttaggccggcagtggcattatttcctcctccaaaacggttttcaaggtgatgtgttattccaatgtaaaagactttatctacattttcaatcatggcttccaggtttttgaatccggaatcaagactttgattttcatcacaaaaagcggatgcattttcaatggaagcaataattcctatccggttttcgttacctggctctttataatgatccttattataaagaaagaagttttcatttttggtaagatctgaaaataagcggctctgtttcaacccataattggtgctgtctgctcccgttcctgcgtacattgccatcacctgaacttttacatttccttcccgtaaataaggaagtgagcagcccagctctttatcatcaagcgtggcacctgatctcagcatataataaagtaaatcgcagtggagatcaacattgattgtattcatattaaaatcgtaattcgtttattattaaagctttaaatcagaaaataaatcttaaaactgaaatgatgaatgatcaaaaatcagcagatacttttcactaaaaaactgattatagaatttaatgagacaaaagctttcttcatctttttcattttaaatattaattctcattctaattgtaagctaatatagtattttatctaaaaaatgcgtatttttgcatcttaaaatttcttagtaaacaatgataaaaattacacttccagacaatagtgtcaaagaattcgagggagcagttactcccctagatgtggcaaaatctataagcgagggattggctagaaataccatttccgcaattgttaatgacaaacaagtagaaacgaccacacctataaccacggattctacggtacagcttttgacctggaatgatgatcttggaaagaaggctttctggcactcttctgcccaccttttggcgcaggcaatccttgagttttatcctgatgctaagttgaccattggtcctgcgattgaaaacggattctattatgatgtggatttcggggatgaaagcttatctgaaaaagattttgaaaagatcgagaaaaagatcttagaaaatgcaaagaaaggttctaccttctctctgtatccggtttctaaagaagaagctttaaagacttatgcagacaatccgtacaaagtggagctgatctctaatcttaatgatggagaaatcacttttgtaacgcatgataacttcacagatttatgtcgtggtggtcacattccgaatacgggaatcgtaaaagcggttaaaatattaaacgcagcaggagcctactggagaggaaatgaaaagaatcctcagttgaccagggtatatggtatctccttccctaagcagaaagatcttactgaatatcttgaaagactggaagaagctaaaagaagagaccacagaaaattagggaaagaacttggaatttttgcattctctgaaaaagtaggtgccgggttaccgctttggttgccaaaaggaaccgctttaagaagaaaactggaaaatttcctttctgatgctcagaaaaaaggaggttatgaatttgtaatgtctcctcacatcggagcaaaagaattatacgtaacttcaggacactgggataaatatggagaagacagcttccaaccgattaaaaccccgaatgaaggagaagaatttttgttgaagccaatgaactgtcctcaccactgtgaaatttacaaaacgtcacaatggagctacagagatttgccaaaaagatatgcagaattcggtacggtatacagatatgagcaaagtggagagcttcacggattaacaagagttcgtggatttactcaggatgatgctcaccttttctgtactcctgaccagctttctgaagaatttgagaaagtaattgaccttacactttatgttttcaagtcgttaggatttgaagattttgtaactcaggtttcgttaagagatcctgaaaacaaacaaaaatatatcggttctgatgagaattgggagaaagcagaaagtgcaatcatcaatgctgcagaaaagaaaggtttaaaaacagttatcgagtacggagaagcagcattttatggccctaagcttgacttcatggttaaagatgctttaggaagaaaatggcagttaggaactattcaggtagattataaccttccggaaagatttgatcttcattatatcggaagtgataacgaaaagcacagaccggtaatgatccacagagcaccttttggttctatggagcgttttatcgctattctgttggagaatacagcaggtgatttcccgttatggctaagccctgatcagtttattattctaccgatcagtgaaaaatatgtagattattcaaaaaaagtttcacaatttttggaaaatcacgatattagcggtcagattgatgacagaaacgagaagaccggtaaaaaaatccgtgatgcagaattgaagaaaattcctttcatgctggtagtaggagaaaatgaagaaaaagaaggcacgatttctgtaagaagacgtggtgaaggagatcttggagtgatgaagctggaggattttgtagcttactttaaaaaagaagctgccatataaattgaattaaaagattaaagaattaaaatattgaaaaattactaagtgtaaatcaatcttttaatcattatttttttaatcttttaattgagaataaaatagtaattaaccaataaaattataatacaatagcacaaagatttaacaacaggggcccacagagacgtccggtacaagaggacgctcacttgatcaacgataaaattcgtgtgagagagcttcgtttggtgggcgataacgtagagccgggaatttatccaattgacaaagcaagacagattgctgcggaacaggaattggatttagtagtcatttctgacaaggcagaaccatttattgcaagagtattggaatataagaaattcttatacgagcaaaagaaaaaacagaaggaacttaaagctaagcaggtaaaagtggtagtaaaagagatccgtttcggacctcagacagatgaccatgattacgaattcaaaaagaagcatgctgaaaaattccttgaagaaggttctaaattaaaaacctacgtattttttaaaggacgttcgattatctttaaggatcagggagaaatcctgcttttaaagcttgcccaggaactggagcatgtgggaaaagtagaccagctgcctaaacttgaaggaaaaagaatgattatgatgatgagtcctaaaaaaccggcaaaataattaagtcattattttacatacaaacctcaaagcaatttgaggtttttttattgcttttaaagaaaaagaccgttgatcaggactactctgctgtctgagtcaacggtcaatcatttaaaagatatttaaccttcaaaatcaccgcaatcatgctctttgaaaagcggtaaagcttttttagtagtgaaatatttagagactcttttgttttttaattccagcttctggccttctataaccagttcgtagaccggagccttatcaatttgagttaaaatatatgttctttcaggagttgtaaagaccgctttattttctgctctgtcagagaacgaaaaatcgtgaatttcaaaaatgtccttttcatcacagacatttgtccatttgattgccttctttgtgatagacaaacttgccaggtcacacgaataacagtttccggaaaactctacgccatatttttcatacacatgagtgctcttgatattcaaaacatcaataggaaccaatgatgaaaaatcagttggaatatcggattcttgtctatctttttttacctgagcaggagcagaaacctgttttacgtttgcgttttcagaatctgcattgttcatttttttatctgtagcaggagaacatgcagctaagattatgattgcaattgacaggctggttattatgtttttcatctttaaaaataatttacaatatctggtttatcttttttgtaaaattctccaaaatcctttgttcaacacatccctgttttcagccatttatcccttattacaagccgttttgctaaatgtcgtctgaacaaagatgcattcactacaaagaatgttatcatttattaattgattttccacagatttacaaattacgcagattattatgtttattgatactgccgtttattttccggatataagattaaaaattgatattatggaaagataaaaatcaggaaacggcaattcaaaaacccctgaaaccagccagtgtgtatggatataaagtctaatatctttgcagcaattatttaaagagatacaatgaaaaaattaagtttgaccatccttttttgtttgttaagttttatggcttttgcacaatcattaaaagtagttatcaaacaggatggaaaagttattgagccggtaaatgatgtttatgaactgaaaaaatctcctttcctttttgaaattacatcaaccaatctggaagggttcttagtgggagccactacgaataaggatatttatgcgggagctcttggcgttttaaatactgaagttgaatggtttcagaacacaggaatggcagaggaattatataacaaggacaaagaaatgttcctgatggattctgccccttcgtattggtactatacagatgcgaaagatcacaggtttgacaaaaaccctaaaggcaatgccaagcaatggactgctacacgtactattacaaggttttatgatattatggtagatcagcccatcaatttgaaagattttaacggcagcgttttcatgctgatgtatcagcctgtatataatgacgagtatgatttaacagacaagaaaaacctgtttcaggctgcgttgaaattcagagattaataaatacacaccaaaattatttgattatataagaaaaaggttgctttcattatgaaaacagccttttttgcgatatatattttattcaataatcaacccatattctatagctaatctgatggctgaactgagattggatgtctgaaacttttcaataagatttttcctgtggctttctacagtatggggacttataaataatttctccgccatttgattcgtagtaagtcctttggcggcttccgccagaatttctttctctctgcgggtcagtttcggaacctggtttaatccgtcagctgattttttcttcagaacagactgcgtttgtgaacataaaaactgttccccttcatataccgcagtaatgccttccaaaatctcggaaacagatgcattcttttgaatatatcccaaagcaccttcagctaaagtactgttgattacaggcagttcattgtgaacgctgaggatgattatccggaggttgctatactttttctttaagggtttaataagttcaatgctgttggtatcggcaagattgatgtccagcaataaaatatcaacagcctgttttgcaaggccttcattcatttccgaaacatttttgaagcaatctaccacgtctattgtgctgctgtttcctaaaatattcttcaatccttccaaaagaagtggatggtcgtctgttatggctacttttatcatgtttaatgaatagggatttgaatttctatactggtaccaatattcaattcggaagtgatattcatcgttccttttaaaaactgtacccttaattctatattgtgaaaaccggctgttttcctcacgtccagagctgcgaggtcaaagcctttgccattgtcctctaccgtaacgttcagctggttttgttcttcgcttatctgaataataatttccgaagtctcggcatgttttatagcattgtttaccagttcctgaatgattctgtaaacgatcagctgtttttcctgggacaacgaattactgtaattgataaattcggtatggatatccagtgcgttgttggatatgcgggaagcaaactcttcgatagcaacctccaaaccatatttcattaacaaatcaggcattaaattatgtgcaacccgtcttaactcttctactgcaccatcaatctgttcaagtgatttcgaaattccttcctgtaaattttcggactgatgaggatttaaataagacagctgatgtttggtcccggaaagcaatccgcccaatccgtcatggagatcacgggccagcctgccacgctcctgttcctgcccttgaagcaatgccgtaagtgttgaaattttcgaattttgtttttcttgctccatcgccaaggcatgtaattcatctcttcgcttaatggaccgggcacgttgcttataggcataaagcagtaagaatatcagaataatgaagaagataataaaaaagacataataggtattgatcttttctttaaaagcgagcagctttttataactgttgatatcattattcttctgttgggtctctaactttgccaggcgaagctgttgttcttttttctcggattcaagttctgaaaacttcagccgttcccgctggttttcttccaccagctttaagttgttgtatacctgttcacgctgtgcccggactatattaatcaacttgatttcctgcgcttttttatcactttccagctgcagcttgatgtacttctgttcttgccgttctttatcaaactgagattccagtcttttggtaatatccagtttttcctgatcgtaaacgtttttgtactgatcaacataacttttgtaataagtcagagcctctttgtagttcccctgttgttcgctgattctggataaagattcaagaatagccagttcaattctctgatctctgaccggactttttccgatttccatagaagctttcagaaagtaggacttcgccaaatcataatttttatcctgtatagccagttcagccaggattccgaatgaggaagcaatatgaatggcatcaccggtttccagactcacacgattggccagctgagcatactgcatggccttattgctgtcaaaaccggtatataaattggctaaattgattgcagcatatgacaggttgctcctgttaagcattctatctttatttttgttaaatgttgtaatggcctgcaggtaatactgttccgttttatttctaaactcagtattggatggaaattgggtatatttttgttcatatacatagcccatccgcatataggcatcgaaaataagattaggatcattttgtttggatgccaggagcaaaaattgtttgctgtatttctcctccagctgatattcattgaggttggcataaatagcggacagctcttttgctgcattgccaaatcttgcatacaatgtagaggtcgttggtgagttttcgaaatactcaatagcttttaaataggcggcgacagcatctgttgttttattattacgttccagaatccagccttttgcgtaatagtaatagcctttagtctcggtgctactcgtttttaaactatatactcttgccatatcaaggcttttcatagactccgctgctttattatccagccggtaattcatggcctgcacagcgtataaaattgtggcatattttccatcagactgctttctcgcgatggaaatattggtctctaagatctgattagatttggatttaagatcatgaaagaataaggcacttgcatacttgggagcaagattgagctgctctgctgtattatttgacgcatggttgtattccttttctaatttgcttaaaatgtcctgcgcatgtacaaaaaacggactgacaagtaaagtgaatataaataatagcctgcgtatcaaatctttatctttatgaagttgtaatatagtaaagactgtaaatataagtaaatacctgctaatcgaccttggtctgttttcctgaaccgaaaagcaggagcaacaattacttttacagcttcttttcctcccaatttacctggctgttgtttttacccatactttttagttgtgttcgttcgaaataagaatttatcattgaatcgggtatgaaaaagaaagctataaaagttgtacattcatatttatctaagagaatggctatcaggaatgattatatgatcatgattttttaaccgttttgtctttgacaaatttttgcgtcaaaggtaatgataggagccatacgaaaatatccctgataacagtggtttttagtgtatccttttttacttctactcccatgaattttaaggcatataagttccaccttgttcaaatagcatcatatagcaaaaagaaacagccagtacgactccggtaagtccggaaataacaaataaaagaagatagtatgaagcctttttacttttcttctgtaaagaattaataataaaagcaatgagtgtacatattaatcctgctccgaaaaaaatgattagcacagcaaggaataatgctctttcaaggtgtaaatctgcagatgaaagcattggtatattaaatttatgggttaaaatgaaacttccgaaacttagttattcaatattagagagaattacgggatatgacaatcccgattatcaggtatatttgatagtacagaaggtttcaaaccggaaggtgcattgttcttattgatgtacattaaaatttcctttcatagatgacttttttttcgtaattttgcaaactattattcctgatgtctttaggaaaccataaacagatattgataacaaaaacaataaaaaagcaaaacaatgccaaaattaaaaacgaaatcaggtgctaaaaagcgttttgctcttaccggttctggtaagatcaaaagaaaaaatgcttacaaaagccacatcttaactaagaaagaaactaagcagaagagaaatcttactactacttcttacgtagctaaagtggacgaaaaaagcgttcaacgtcaattagcaattaagtagtttttataaatctatattcggtttataagaattcaaaacaaattcaacaatttaaccctggaacggtgccaataaagagtaacagctgttaccgcccttttcaaaaaaacaatttaaattatgccaagatcagtaaatgccgtagcttcaagagctcgcagaaagaaaatttttaagcacgctaaaggttatttcggaagaagaaagaacgtttggactgtagctaaaaacgcggtagaaaaagcaatgcaatatgcttaccgtggtagaaaagagaaaaagagaaatttcagagcactttggatcactcgtatcaacgcgggaactagagagcacggaatgtcttactctcaatttatgggagctcttaaaaagaacaacatcgaacttaacagaaaagttttagcagatttagcaatgaatcaccctgaagctttcaaagctgttgtagatcaagtaaaataatgtagaatagattttgttatcaatataagtcccgggatttcccgggattttttttgtggtatcctttttttgcttcagtttaaatttaatctgtgcaacttatgtggagtttaaaacaaataataaaattcagccttacctaatgacaaatggcataagaagatatatcattgtcaaaaaaacaagaaaatatgcattgcagcgaacaactaataataataaataatcatttattactatattagcaatcctaaagaaagtataaaaatgaaaaaagttgcagcttttttgctcacttccatcgcactgcaaaatacgagtgcccagagttttatccaagcttataaagacagggcagatatggtaactcaaaccaatattaacaacaatcttcaggaatttgcaggatttggggtaaaaagaacaggcacagcagccaataccaatgcgctgaactggcttaaaaataaatatgcctcctatggatataccgcaaatgatctttctgaggacactttcacttatggaagtaatacttcaaaaaacctgatcattaccaagaccggaactttgtatcccaaccaatacatcattatctgcgggcattatgatacaataacaggtccgggagtaagtgataacggaagcggtacttccattattcttgaagcagcaaggattcttaaaaatgttcctactgaatattctatcaaattcatccatttttccggtgaagaacagggacttgttgggagcagccattacgtaaataatgtggcataccagtcaggtacaaaagttctggatatcaagcttgttttaaatattgatcaggtaggaggattgcttggaaataacaacaatacaatcaactgtgaaagagatgaaggaggaatgtccgccaacaatgcagcctcagatgttgcaacgcatgagcttatgacatgtacaagtctttattctcctcttcagaccaacctctcttacacttacagctcagattacatgccttttgaagctaaggggtatactattacagggttttatgaaactatcgaaagtaataatcagcataccgtaaatgatacttttgccaatctggatccggtgtatgttctcaatgtaggaaaagcagccgtgggagctttgcagcattttgccgttgcttctacaaccaataatctgctcagcacaaatgatacctctttacaaaaatcaggtgaagtcatcaggctttatcctaatcctgctaaagatctggtgactgttgaatttgagcaaaaagtaaagcaattcaaaattgaagtgaatgatatggcaggaaaccttgtcttaaaccttgaaaaccaggaaaaaattaatacatcaggattaaaaaacggagcatatacctttaccattaagactgataaaggaaatacaaccaaaaaaataatcattaataaataatatcaggacggaaattttgaatcagacagcattcaaaagatatccgtattacgattatataatgaagaaaatcattacttttttactcgcttctattactttgcagagcattgaagcacaaagcttcattcaggcttatcaggacagagcgaatatggtgacccagacgaatatcacagccaatcttcaggagtttgccaacctgggagttaaaaccacgggttcaacagccaatgccaacgcactgacatggcttaaaaataaatatctttcctacggatattccgccagccagattacagaagatccttttactgcaggaagtcataattctaaaaacctggtgattaccaaaacaggaactgtatatcccaataaatatgtgatcatatgcggacacttcgacagtattaccggtttaggaatcaatgacaacggaagcggaacttctattattctagaagcagcaagaattctgaaagatgtacctacagaatattcaattaaattcattcatttttcaggtgaggagcaaggacttctgggaagccagcattatgccaatacggttgcttatcagaacggaacccgtgttctggatattaaactggttttcaacctggatcaggtaggcggagtgatgggcaacaataacaataccgtttattgtgatcaggaccttggagggcttacttccaataacgcagcttcagcagctgtaacccaggaactcagaaactgcacggcactctactctcctcttctgacagccgtagacccggccgctgatacggattatattccttttgaacaaaaaggtgaagtgatcacaggtttcttcgaaagaatcagaagtacgtatccacatactgtgaacgatacttttgccaatacagatcctgtatacatttacaatatagggaatgcatctgttggggccttacagcattttgccgttgctaccggtactttgggcacccatgaagccactgtaaaaaacatattggaaacggtgaaaatttatcccaatcctgcaaaagacatcatcaatattgaacttcctgattccggaattaaaaattttacttttgaaatcactgactttcagggacgttccattttcaagaaaaacaatgaaacgaaaatcaatgtttcaggattagagaatggtgcttatttaggtattttaaaaaccgaagatcaaaaggtcgtaagaaaagtgatgattgaaagatagcaacatgactataaaaaatagtaacagaaacctttgaagtaattcagaggttttatttttttcaacaccttgttgaagtatttatagcacatagccaacattggtatgatattcataataaaattcatgtgattttgatacattaaacactttattgtgatttatttactacattcgtggtaccaaaaataatatcataatatgaaaaaattaacaacacttttatgcactgcactaatgatgcagagtattgccgcacagagttttatccaggcttacaaagacagagcggatatggttacacaagccaatatcactacaaatcttcaggaattcagcaatttaggcgtaaaaaccactggttcggtagctaacgcgaatacgctcacctggatcaaaaacaaatatctttcttatggttatactgccagccaaattgtagaaagcccttttacctttggaagtacaagttcaaaaaacctgatcatcaccaaaacaggaacactttatcctaataaatatgtcattatctgcgggcatttcgatactatttacggtccgggagttaatgataatggcagcggaacatctattatccttgaagccgcaagaatcctgcaaaatgttccgacggaatattccattaaattcattcacttttccggtgaggaacaggggttgagaggaagctcccattacgtgaataatgtcgtatatcagggaggcgtgcgtaagttagatataaaactggtcttcaatctggatcaggtcggcggtgtaaaaggaaataacaacaatacggtatactgcgatgaagatcagggaggtgtttccagtaataatgcagcttctgcagctgttacccagcagctgagaaactgtacggcgctttactctcctcttcagaccgctgtagaccctgctgctgatacggattatataccttttgaacagaaaggagaggtaattacaggtttttttgagagaataagaagcagctatcctcacagttcaaaggatacttttaccaatatggatcctgtttatgtgtacaatatcggaaaggctactgtgggagcattgcagcattttgcaagtgcatcaacaacaatgagtaaacctgctgctaaaaataccctggaaacggcaaaaatctatcctaatccggctcataacgtactcaatattgaattaccggattctaaagcaacgaacttcagttttgagatcagtaattctatgggaagatcaatgctgaaagtaagtaatgaaagaaagattgatgtttccagccttcagaatggagtgtatgtgggagttttaaaagttggtgaagagactcttgttaaaaatattatgattgaaaggtaaatattatcagattcaacgtaagaaaacagcaggaatatcctgctgtttttattattgtaaagctattattttctgtatttcggactttatccgttctgtaatccagtcttgttcttcagaagccagatctccgagcagattcccattattttcattaaaatctgtaaggacatcctgtaaaaactcgtgctgaatttcatgaagacgatccggattgcttttatcaaacgccccgactttggaagttacactttcaaaccggttctgtgttacataagttcttaattcttctgtaataaaggaaagactttctgcttttgaagaaatatccggaacaaatgaccatttttctgctttatgaaacttttcttcttcatcaaattcagggtttttcagcttgataaccgggcgtttagacagcaattccttatcttttaaattatagggtttaatcacaactccttcaatcagattatattccagatcaggaagtccaagctcttttggaaccggagaatttattctggtattgaaattcagagcttcattgaattttcctatgaataatggttttacataggatatcccgaattgctcaaagtaggatgctgcagtttcataatccatataatttttcaatcctgattcatcaacaatggctatatcaaaagcataaaaaagaatatcaggtgtatagtaaactcctgtctgtacagcctgtacattttcaacggcagagacttccgggtgcggataatgtcctccgaataattctccatatacaatatacctgacgccaggcactgcagttctcagatgctcaaacaatgaaagcatcccatcctccaattggctgacaacaagctggaacccaaagaaatcatctttccagtcaagatactctcttcttttagcatatctgagtgtatcattttcataagcgaaactgaaattggcaccatggattttctcagtaaccacccatttcagtttatccatttttgacaattcaccttcattgagaccgagtttcttcaatgaatcaggcattttttcgtatccggaaaattcagttaaggctgtattgttcatattagttgttaaatatattattttagctgacagaaaccatatactttgttatggctttacttgtctctgttctgcaggatctcttcaatcgcttccagcgaaaatccttttgctttcaataaaatcaaaaaatgatacagcagatcggctgcttcatttttaaagagatcatcattactatcttttgcttcaatcaccagttctacagcttcctctcccactttttgagccattttattgattcctctctgatagagcgaataagtataagaatcttcagcttttgaatctattctctgagctattttttcctccagttcgtacaggaatcctttcgcattcttttctccgaaacagctgaaacgtccggtgtgacaaaccacattctttggaactgctttgattaaaatggtgtcctgatcacaatctatatcaatactttttaccgttaaaaagttacctgattcctcaccttttgtccagagtctgtttttggaacggctgaaaaaagtaacaattccttctttttttgttttctcaaaagcttcttcattcatgtagcccaacattaaaacctgcaatgttctgttgtcctgaatgactaccggaacaagcccgttgtctttattaaaatctattttcatcgtacttcaattttttgcgtttttaactgttccttcaattcctgaatccctatttcattaaaatggaatatactggctgccaatgcacctgtagcttttgtttcatcaaacactttaacaaaatcatctgttgtacctgctccaccggatgcaatcacaggaatactgattgcttccgaaaccagtccggtaatacggagatcaaagccatttttagtaccatcaccatccatggaagtcagcagaatttctcctgctcccagagattcagcttgttttgcccattctactgtagagagttctgttgcttctcttcctcctttgatatgaaccagatccttatctcctaccttccttgtatcaatagccaccacaacgcactggctcccgaattctttagctagatcagaaataagctctggattttttactgctgaggaattgatactgattttgtccgctcctgcttccaaaagctttcttacatcttccacagacgaaattccgcctcctacagtgaaaggaatactgagttcttttgcgatgtcttttaccagctgtacaaaggtttttctatcttcaatagtagccgtaatatccaggaaaacaagttcatcagcaccttcctgctcgtattttttagcaagctctacaggatcccccgcatttttaaggtcctcaaaattgactcccttcacggtagacccgtctttaatatccagacatggaataattcttttcttaagcattttcaataaaattttgaagttgtggtaagcttatttttccctcataaatcgctttcccgataattgttccggcacatccgatatttttcattttatagacatctgtgatgcctgaaatgcctccgcttgcgaccagctgaactgatgttttatataaaatctcaatatataaagctgttgaagggccttccagcataccatcctttgcaatatcagtacaaatagcggtttgtacccctttttcctgatactgaaggataaaatcaatgatatcatgagcactttcttccagccagccagaggttttaatttttctgttttcgcagtctgcacccagaataattttttcagcgccatacttttctatcattccgaaacagaattcaggattctgaaccgcaatacttcctaaagtaatctgttttgccccggaattaaaagctgtttcaatatctttctgagtttttaagccacctccaaagtcaatatgcaatgaggtagacctggcaatattttccagaactttctgattgacgatatgttttgatttcgccccatccagatctaccaaatgtaggtactgaattccaaagctttcaaactctttggccacttctacaggatcttcattgtatattttctttgtattgtaatctccttttgataaacggacacatttcccgtcgataatatcaatagccggaattattttcatgattataaatttataaagttcttaacaatctgatttcctactattccagatttttcagggtgaaactgtactgcatagaaattgtctttctgcaaagaagcactgaatggcaggatataatcacaaacagaagtggtaaagtcagaaagctcacaataatagctgtgaacgaaataaacatcactactttcttcaattcctgaaaacaatggcgaagtcttcccggaaacggtattccagcccatatgcggaacaatatcctttgaaggaaattttctgacattgatatcaaaaattcccattccttccgtatttccttcttcattttccccgcacatcagctgcatgcccaggcatattcccaaaaccggctgtttaaggcctggaatcaaaacatcaagctctttttctttaagcagtttcatggtggatgaagcttctcctacccctggaaatatcactttatcggcctttaagatcttttcaggatcatctgttattatcgattcaacattcagtctgttgagggcattctgaacggaatttacgtttcctccgttgtattttattatagcgatcatacttataaacttccttttgtagaaggtaaactgtaattagcatctgactggttcactgccattttaacagcttttgcaaaggctttaaaaatggattcaattttgtggtgttcattatccccttctgctttgatattcagattcgattttgaggaatctgtaaatgacttaaagaagtgaaaaaacatttccgtaggtacatctcctattttctctctcttaaattcagcatcccaaaccagccatgatcttcctccgaaatcaatagccacctgggaaaggcagtcgtccatcggaagcaggaaaccatatctttcaattccttttttctttcctaatgcctttaaaatagcttcaccaagaacaattccggtatcttctatcgtgtggtgctcatctacggcaaggtctccttttaccttgatggtaagatccatatttccgtgtctggcaatctggtccagcatgtgatcaaaaaaatgaagtccggttgaaatatctgacttcccgttgccatcaagattaacttcaatttcaatatcagtctcattggtttttctggatactttcgcctttctcattcctgatttcaagaactgatagatctctgaccattttgatgcagacagctccgcttcactatttaagttctgattaagataaatagctttagccccaagatttttagcgagttgcacgtcagtacttcgatcaccaattacataggaattttctaggtcgtaattgccgtaaatatattttcccagcattccaatacctggttttctggtaggaagattttcggattcaaagcttttatcaattaaaatatcactaaaaatgattccttcgttttcaaatgcctgcagcattttttcctgtggttttataaaatcttcttcgggaaaactctccgttcccaatccatcctgattggtcaccatcaccaaatcgtaatccagttcattggcaatttttgacagattctgaaaaactcccggataaaactcaagcttttccagagaatctacctgaaaatctgtaggcggttcaataatcaatgttccgtcgcggtctataaagagtacttttttcattttagatacttttcaaaaggttaatcaatttttcattttcttcacggtttcccacattgatcctgatacatccgggaatcgcaggatctcttctgctggccaaaatctcttcttcaagcattcttgtatacactgaatcaacattttccattttaatcagaaagaaattggcatctgttggaaagacctttgaaatacatgcagttctttcaaattgctgcttcagccaagttctctcttccaaaatacggtttacgttttcctgaagcctgccttcatcttccaatgtctttaaaatcaattcctggctcataacattcacgttataaggtgcttttacggtattgataagcccgatgatttcttcagatgcataagccattcctacccttgctccggcaatcccccaggctttggaaaaggtttgcagcacaatcaggttagaatattgctccagcagctccagacttgattttttttctgaaaattcgatgtacgcttcatctaccacaacaattccgttgaaattctgaaggtaaaattcaatatcatccacgctgtttcccgtaggattattgggcgaacataaaaagaagatcttcagtgaagaatctttcgctgtctctaagaaattatcttttacaatttcaaaattctcatccagatccagttttaaaactttattttcattaatggctgcataaaagccatacatcgcaaaagacggattcatcatcagaacggcatcttttttaggctcacagaaaattttgatgataaggtctatcaactcatcacttccattccctatggcgatctgtgaaggcaaaacgtttttaagctccgcaagcctgtttttaagatttttctgggtagaatccgggtaacggttacattctccaaaaggactttcattcgcatccagcatgatcggggaattgaattcattttgatccctgaaactgatgtagggctgtaattgtaatatattttctcttaccagagttttgatactgctatttttcattgtattgtttatctaaatctgtttttaaaccattaaatccaggatctttatttttcaaatggttttatgattttccgtttttcaacatttatcattttaatcttatggatactgcatttttgtgagcaaacaaaccttctgcttcagccataagctctatggtttttcctaaattctgaagacctttttttgaaagatgctgaaatgttattttcttcacaaagctatccagtgatactccgctgtaattctttgcataaccattggtaggaagcgtgtgattggttccgctggcataatctcctgcactctcacaggaatagtttccaaggaaaaccgaacctgcattctcaatcaacggaatatatttttcaaaatcggcgatagccagaataaggtgttcaggagcataaagattactgaactctaaagcttcttcgagagaattcactaaaataaaagagctgttttccaaagcctgagcggcaaattcatttcttggtaaatctttgatttgctgatcaacagcttctatcgtctcttcaaacactttaaggtccgtagtgataaaaaccacctgactgtcactgccgtgttctgcctgtgaaagaagatctgcagcacaaaatccgggcacagcctgctcatctgcgatcacaagaacctcacttgggccggcaggcatatcgatggcaactccataccgttgggcatattctttggccgctaccacaaactgatttccgggaccgaaaattttattgacagccggaatactttctgttcctaaagccattgctgcaacggcctgtgctccacctgttttaaagatctctgaaaccccacaaagatttgccgcatacaatattgccggattgatatttccgtttttatccggtggtgtgcaaagaacaatctctttacaacctgcaagattagcaggaaccgcgagcattaatacggtagagaataatggagctgttcctcccggaatataaattcctactctttctattgcacggttttcacgccagcaaacaacccctttcactgtctcaactttctgaatttcctgcttttgagaagcgtgaaatgttgaaatattttctttagcctgttggatagcctgtttcagttcattgctaatctgtttttctgcgttttcaatttcttcttcggttactgaaatgctttgagtgtctgctttatcaaattttttattgaattctcttaaagctttatctccgtttttttcaacttctgcaaaaatgtctgtaataagtcctgaaatttctttctgttccaaaacagggcgttttacgaggtctttccagctgtcttttgtgggatatcggtatattttcattgtattatttttaactttttttaaaccattaagattcttttaagttgttaagtttcattaagatcatagctgaagctatttattaagcgggcttattcctttcatctttgatgaatcttaactatccttaatatctttatggtcttaatggtttatatttttaaataaccattttatcaatcgggatgattaaaatgtcctgggcaccattttctttaagttcatcaatcacttcccagaaacgctcttcatcaatcacagaatgaatgctgctccagccttcttctgccaacggaattactgtggggctctttaatacaggaagaacacctgctactttctgaattttttcattgggaacattcatcagaatgtattttgaattttttgcttttaaaacagctttgattctgaagacaaatttttcaagaatagtttctttttctggcgacaactgaggcgtttgagccaaaacagcttcagatttcagtaaagcaaccgtttctcttaacccgtttttgaataaagtacttcctgaactgacaatgtcacatattccatctgcaagaccaatattgggagcgatttccacagaacctgaaatgacgtgaatatctgaagagattccctttttttctaaaaaatttttgagtgtattgggatatgaagtggcaatttttttaccgtgaaaataagagagctcatcagtttcaacctccttgggaacagccaatgagacacggcattttgaaaagcccaacttctggattgttctgatatttttgcccttctcaatcagaagattttcacctactatagcgacatccaccactccgtcttccaggtactgtgggatgtctgagttgcgcaggtacatgatttccatcggaaagttatctactgaaactttgagctggtcttttccgttgttaacaaagattccgcaatctttgagaagctgtaaagattcttcgtaaagccggccgcttttttggattgcaatttttaatttactcattttgccatttttgggtctgagcaaataaaactgatctgttgaaatttctgaggagaattcaggaaacaaaaaaaccgtctatttactcagacggtttttaattatttttgattttagcatatacttatatcaatcaattccgtctagcagagatgatgatgataatgatgtaaagctaaaaatgttggtttcattgtattgaattatgatgcaaatgtaggattattttttaaaatgcaaagttttttcagataattttttgataaaaattcatcagttggctcgcaatgggtttgtcattaaatttctgaacaaactcgaaacccttttcttcacggcgttttctctcggattcattttcccagagaaatttgagtttggcgcgaatatcgagatcgttatccggattgatgtacacagagtcttttcctcccgcttccggcagacagctcgtattgcttgtgaccacaacagttttagaaaaaagcgcctcaatgacaggaattccgaagccttcaaagaagcttggataaacaaaaatatcagcaattttatagattgcagacagctcatccatagaaactccttccagaaacagcacctgcttctccattttgttctttttcaggaaacgctctattttctggtaatatttggtctttcttcccacgaccactaatggaatttcagtcccgttgattgcttttacaacattcaagaggtttttacggtcttcaatagttccaacattgagtacaaatctttcgggaagcttaaacttttcttttacagcctgtatcaattcaggagactgctgttctttaaaagcatgatgacaaccctgataaatcacttcaatcttagtttcaggaactttcagaaactgaataatatctcttttggtctgttctgaaatagcaatgattttatcagctgtatcggccgcttttttaaatttccagaaatggattttcctgtcaaaaaaagaataatactgcggatatcttacaaaaatcagatcgtgaatcgtcacgacctttttaataggcttttgatcccattttaagggaagttcgccggataatccatggaaaatatcagcgccttgcttctgggcatctttacccattttaagctgacgggacaggttccctttggaggtttcaataaagtgaacattagaacgttccagaatttcctttcctctctccgatttgtttttgttgagcagcagatattcattatccggttcatattcagaaagaatccttacaagatctctagaataatttccgagacctgacgtattgtggaaaaaccgtttggcatcaaaggcaatcttcatcgttgaatctgtttttgaaattcctgaaatgtaccgaatgtatgtcctttttgtttcagccagcctacaaatgaatcaaatctttccaccatatccttccctgagttttttacggtaaatccaggaagtttaaaggcttcgtctttaatttctgcaaattcccacgggtggaaataaatattaagataatggtcttttttcaaggtatctgaagacagttttttatagaaagacaacgggaaattgtgaaagcttaaccaaaacagaggaattctgaaattaggagaaaccgaagccggaacctgcattacatttccttccttgaaataggtcctggaaactttcaaattattatatcttcccggcaaaaatgtagggttaatggatgaattgtatacatatcctgctttttctacttgtttttcgtctacaggcatcattctcggcattcttaatccggtcacctttgtagaaaataattcttccagtctttctcttgattctttcaggtgtttgttttcaaattctgaatgaaaccaggtatgggaagccagttcatgaccttcatttaataacctttcgataaggtgtttgctgttttctgcaaaaactacggtagaaaaaaaggtagcttttgcattatgttttttaaggatatcaaggattctctctaatcctgtctgtgaaattgaaatctgcttttcaaagggaatttcacccttatattctaatggcatatcaaattcttcgatgtcaaaactcaataaaaccattctaaaaatttttgtttttaataatataattaggtctgtctttcacttgtttgaatattttacctaaataaatccccatgattcctaagatgatgagctgaagtcctccaaagaaaacaatggtcatgatcagggacgcccaacctgaaatctccgttttggcaataaatgaatgaattacgtaggctccatatccgattactgaaagtgctgagaataaaaatcccaggtaagctgccagataaagaggcttcacgctgaaagccgtaattccggtgaaagcaaaagtaaacatctttttgatattgtaactgctttttcctgaaagtctttctgcggcggtaaagtcaattcctgtttgtttgaaacccatccagctcgttaatcctctgaggaacagatcatcttcattaaagtttctcatgacttcaactgcacttgcatccagcagtctgaaatctgagccaccacctttcgttaagtttacatctgaaaggcttgataaaagcttgtaaaataaatctgatgtttttcttttaaaaaaggatatttctttaggataagtcctgaaagtaaaaactacatcatagccttcctcccatttctttatcatttccgggataagctccggcgggtgctgaagatctccgtccattgaaatgactgcgtttccgtgggcattgtccattccggcttttacagccggctggtggccgaagttacgggaaaactcaatgaattttacttcgtcatactgattggaaagttcttctaatttctgttgtgtattgtctctgctgccatcattcacaaatatgatttcaaagtcataattgcttaagccatcaaaaacttctttgattttctgatggatcatcgctacatttccttcttcgttataggcaggaattacaattgaaattttcttcatatgtattaattcaggctgtaatttttctcaaaatctttagtcagaagttcataagtcactctcaaccagattacaatacaaggtacggcttttaatgaatatttaatgatataattctcttttacaaatttcgggaaaagatccgaagttgaaaaacatgtaaaaataatgacaaaaacaaggagtcctatgatcagcggtgttctctctttctgaaggaaaaaccagattaaaacgcccacaacagcaataatgtatgttggagattctgaacttgaactgaataataccaaaaacagtaatgttgacgctaagatcatcaattggaaagcataatgcttatattgcttaattctgatataaggtaaagcaaaaagcggcaatccgcctgctaaaaacacaagattggaaatggaggcatcacctaagattcttcttacaaatcccattaaagaaatgtcctgcatatttcctaacacctgattttcattatttttttctacaatagactggaaccagtctgagtagcactgaatcacaaactgcggacttgaatacgccattggaagcacgaaaaacaatacggcaatggctactcctgaaagaataaatttggttttgtttttaatgaagaaaaactgtgtcaatccgacaattccatagattttcacaaatactccgattaaaattgcggttacagattttacttcttttctttcgtaaatatatactgcagataacagcaaaaggcctgtcagcgctacattgaactgcaggcttaatgctgctgtaatgtattcctgaagacaaagcaacccgaaaatcgcttttttactgtctgaaaacggcagtttgtaaataccataaataaagataaaagtattggcaatgttccagagtgagatccccagccaatccggcatcatggcgaatggtgcgatcaatgcactgaaaaatacaccataatggttcagatcaaaataaagatcgggataatggataaataagtttttctgatgtatggtattaaagaatacatttttaaaaatcagataattattgatcgcataatctcctctcagatatttggaaattgcggtaacaaccgatataataagataaaccccaaatatatatttagggtttaatagtattttaagaaatttttctttcaagattgtggtattagcttaaaaaattaatcttaaacagctacattattgtctctcaatgcgtcattcagagatgttttcttgtctgtagattcttttctctgaccaatgatcaaagcacatggaacctgatattctccagccggatactgtttggtatagcttcccggaattactactgaacgtgcaggaactcttcctttgatttcaacaggtgtatctcctgtaacgtcgataatttttgtagaagcagttaatactacattagcacccaatacggcttctttttctacgtgaactccttctacaacgatacatcttgaaccgataaagcagtcgtcttcaatgattaccggtgcagcctgtaatggttccaatacaccaccgatacctacccccccactcaggtgaacgtttttaccgatctgtgcacagcttcctactgttgcccatgtatctaccattgttcctgaatctacatacgcaccaatatttacataagaaggcatcataatcactccgggagcaatataagctccttctctggcaactgcatgcggtacaactcttactcctttttcagcataatttctctttaaaggcatcttgtcatgaaattcaaacggacctacttcaatagtttccattttctggatcggaaaatacatcaccacggcttttttcacccattcatttacctgccatccgttttcagtaggctctgctgtacgaagttcacctttatcaaccaaagaaataacctctctgattgccttctggctgtcttcattctgcaataaatctctgttgtcccagatattttcaatagtttgttgtaacgacatgtttcttatttaaaattataccggccaaagatacaaaaaagttcagcaaaacggtttttaacattacggttttaataaaggttcagcattcgcttcaccctctttttataggccgtatagatttctccatgttctttctgcagatattcttcttcaaggcgtatctggatctgcattaacatccctccaatgatgagaaaagaaaaagcaataaccgtaggcaatacaagaaaaaatccaaacaggctcattgtcattcccaaaaaaatgggattccttgaaaatctgaataaaccccgggtaacgaagtctgtttttgttgtactgtcgattccgatccgccatgagtttttcatttgcagttgggctgtaatcacccaaattaaagccaaaatcatgatagcaagtcctgaatatttgactgcatcaggttccggaatattgattttaaaagctgaaaaaatgtcctccggaaagagtaataaaagcatcgtgtagataaacagagccgacaaaatcagcttaaagtagaatcccacaaggccgtatgcggaatcatctttaggaagaacgtcaggatttttgccgatctgttttgcaactttataacttatccccacaaaggaaactgtaaagaaaagaatgaagtaaaaaggaataaagaatctgatgaaatctgtcatatgattatagtttctgacaaatttcatgagttttgggatgcaatgctattgcaatgacaaggaactttagtttaagcaacagaattcctctccggcggaggggtgacaaaaattcagagaatttttgacggggtggtctctaaaaatatagttataagttttggctaaagccagttgattgttttatttatattaaacgggctaaagcccgtccctattgaattattgctcccggacattcattatccagcatcttaaacaatactttagagaactctttgtgcatgaagataggccttattccagtatttctcattcagggatgaaataatgactccttttgaagtagaggcatggatgaatttcacttccccgtcaggaccaatatcgtgaactattccaacatgagaaaccctgcttcctccggctgttgcaaaaaataagagatccccgggttttacatctttgatatcaatattctttccggcttcggcctgatcagaagatcttctcggaaggctgaaatcattttcttcaaatacttttaccgtaaacccggaacagtcaaagccagacgatgaatttcctccgaatttataaggcgttcccaggtatttttcagcatctttcagaatatcattgattgatttggaaacactgccattaaattttgaatcaagtcttctgagattttcagatttaacaaccgttttggtattcgattttttgctggcagaaacacttttcgaagagccgcaggaaactgcaaaaacagatgcaatcaataaaacaggccactgttttattttcatttttgtttcaaataatgccggtcccatatccttctgatttatacttgtttaacaaattttatacaaatatacattttatatttaaattatactaaaactatactacaactatattataaatatatgttaaaattttttattcatttatttattggtatatttgaatctattttaaagatatggcaacatatgaaagtctgatcaagatcacaggagctgttggcgacctggtattttataacctgaacgggaaaaatgtggttcggaagaaaagtggttttaataagaacgcttttaaaaagagcccaacctatgaaaaggtaagacaaaacagttcggaattcgggcattgttccaaaatcggaaagatcatccggaacagtttggaaaagtatatcaaagaagcaggtgatcccctcctctatcagaagtttgccaaggtaatgacagccattaaagattttgacaaggtttctgaaagaggaaaaagaagagttacagatgggttaaaaactgaagaaggaaaaatacttttgaaggagtttcaatttggtgtgattcctaatgtttcagattgtatcagaattcaggattatgctatatacaagaatgcggactgcacggcagacgaaggtgtcatattgactttaaaagtagattctgaaaactacattacggaaagtcatgaagaaataatcagctggaaacggcaagaggaaaagacttttaagcagtatttttccggggaagaagttctactttattttgtagtcctgaagaataaaaataataaaattacccatatgggatttgtttaaataaaaaaagtctgcagtagattctgcagactttcttttttatttcttttctcctttccaggttcccgattttgcaggtgttggaagtgagtttaaccagtttccgtttccttttttatctgtggataatgttcctttgaattctcccttcgaaggaagtcctaccgttgcgttcagatctcctgtttcacttaaattcccggaaatgttgtagttttcattattaacatcggaatgcattgttcctaccactttaccgctctcgtctaccacaaagttccagactcctttatcgcttccttcatacgaaccagaccatgttcctacataatcaaagatcgtatcatcatctgagctgcaaccgataaataaaaacgccgttaataaaagtaaaaaaagtttcttcatagtttcagtagttttataacctaaaatcctgttattcctgtacactttccttctaaaaatccagtcacagagaatattgtttaatatttattattttttgtttcgtgcaaatctactaattttttccttcagattatctgaattttaatcagcaaccaatatgtttgttaaaaaacgatatatttcggctaaaatacaaatatttttcaaacaaatacgagtgtaaataatttgagttattaaaaaatatcatcggaaatttcagaataatgaaattcgataggttttttaattaacagataaaattttaaatgatttatatttcagcttttaaagatatttcttaaattagtgaaaagtttagctttttcagatatatcatgaaaataaaaatttttcttttgatatcattggaatttatggcaatttaatagtacaggtagagatcagcacttctgttttcttacaaagggatgctgatgatctcatcatgttaagaggatcttcaaattctgttgccagcaagaccgctgaagtataaagtagagtctgtaaagcggaccatggtaccttgtgcaccttgtcaattcaccgctccggatctttataatagtcgatatttgatttcaaaaaggcagccacagttttatactgtggctgttttttgatacgaactctttaaataaaaataattttcatataaaaagcctcccaaaagaggctaaaaactattggatgaatgaaaaacttattctcaaatctaggaaaacattcctccggttctttatgagtacagtcataatgagatatttaatagctaattacctttatcttctgacgcatagctccatccgtatatccagtctagttgcttaatctgtttactgataaagaatccgataaaaagatcccggaaccaggccgttatcgggtttgtttttgttttggtatttccaacttttcttgcattttttattattttttcaactctgggctgccgtacggattgaaaggcctgaaaggcggcctcacattctttatttaattgtaattgttcagcaataacaacagtatcttccagtgctaacgaagctccctgtcctatatgtggagaaataccatgcgccgcatctccaataaggcagactttccctttataccatttcgaaagtctggggagatcatacaccggataagcaataatttcgtagctattcctgatgatgcgggaaaataaagggtcatcattcctatgaatatctgcaagatggtctttgatttcatctttcagtattttttctgtttcctgtggtttcggctcctgatctctgaaataattattaaaccaccacacctctcctttatctgaaaccgagtaagcaaaaaagcctctttctccaaatgtcatccttatcgaatcaagaggttctgagagctcagcaattttggcatatccgccgatagaaatgagctttgtatatctgataacacacttttttgggaacagctgattccttacctcagaaaacattccatcgcagccaattatcatatcacctgtaacggaagttccatctgcaaagtaggctgttacctgatcttctgattcattataccggacaaattttttattatattcaatctttataccggcttcagctgctgctgcccgggcataggtgttgagatttgccctctttaactgcaaggtctctactccgtacttctgtttttgataagcagttcccagctctgctatctgctttcctctggcattaaaaaatttcattgaacccggagtgtaatcttctttaagcttttcaagatctataaattctttcaatacatttaatccattaggcgtaatgcctaaaaagactccttcatttctgttattttcagatcttgcttcaaatatttctggctgaaaacctatttttttcaattgcaaagccagtatcgggccggcaacacctgcgcctattataattacttttttattcattgttttctatattacatcaaaggatatgtaggtttttcttttgcaagctattctctgttgaattttttctatctttaattctgataatcttgtgtagtaaaattatcacaccaggaaagaagaaacttgtaaaaaaaggagttaaactagcaaatcagggagtaatggggtttgaattgaaaaacagcgaaaggatatttacagcaggctttgatgaaaatgacttcaattcctatggttttaaagaaaatgtctttaagacagatattccttttgggcagataacgaccaaacaatggctctttgacggcatcagaatgctttattctgaaacagagcttgagaaatccacagagcttgactggaagggagatatggaactggtcacgatgcattttaatctccagggaaaaacttcaatacagcaacatggaatgaacagttcttttgaactgaatgggaatcagcataatttattttatggtaccggtgctgaaggtaaaatgaaatgggatgaaccgcaaatgaaatcatttatgattcaattttcaaaagaggcttttcttgcgatatcaaaagacggaaatgaatctctaaagcaatttgcagataaaatagtttcgggaataccagttgctttttcggcttcaaatttgaatatcggcttaccattacgtacctgcatcgattcaattttaaattgtgaattttcaagcggatcaaaacggttgtttcttttttcaaaaacaattgagctccttgttttacaggcagaatcgtttaatactgctgaaaatcagaagtcgaagtatataaaacatgattatgataaggatcgaattgtctttgcccgtgattatctggtgaaaaatataggatcaccgccaaccctaccggaactagcaaaaatagcaggcatcaatgaatataaactgaaacggggatttaaagaaatttttaatcagaccgctttttcttatttgtcggatttacgtttagaaaaggcaaagaatgatttgatggacggtaaaaaacaggcaacagaaatagcgctggagctaggctactgttctttgcagcatttcagcagtgctttcaagaaaaagtttggcattcctccgaaccaggcaagatattaatattagatatgatgtaaacaaaaagctgtaaagaatcaactttacagcttcgttttcatagtatgtttttagaatcttttttagtctgttcagactacatcttagttttggaactttacaaaatccaggtaaaaagaagggttaccaccattgaatgatgccggcactactccatttgtttttccagccaacacagtgtacgttcctggtgcagcaaaatataacaccctgttctgatctcttggaaacataaatgctgcagtatttgatccgcagtagcttctccagacatcaccaatgccattgatatagaaaaaataatcattacaatcagaattgatagcgatcccacatcggaaaaaataccagccctttgccggaatagtaacctgaattccggtattcaatccgccacctcccgttcctcctgtaaaaggatttaccaatgttccggtataaggtgtccagttattggcaaatgctgtagtaacagtggaagaccatgttgccaatccgttagcatcactggtcagcacataccccagctgctgagtaccgtctttgatctggagggcaccattggtagttccgttatcaataacaatttttgcactggctgctcctgcaggtactgtattggttcccactagaacttttcctgtaccgttgatgcttaaattgtttcctgctgtagcaatatctgtcggctgtgaaagtgttcctcctaatttaacatctgtaccggataaagtaagaccgttacttgccgtgatattattattaatgatcgttgtaccaccatttccattacctccggccagctcggtaaccgtcataaatcctattccaggatttagctgtgcggttccagcacctccgagccttacttttacagaggtatcaactgttggtttgtaaatagcataggcttccggctggccgccaatagatgttgccggataattgtttatggcatccacaactcctgttgtactggaaggaagaacggaattattggaagcatctacccattcgtacacaaagaatcctcctgccagcgaaaaatctgtagcatgcagctgacaacggagcacgtaggttttacctgctttcagattgaaaacacctgcgttataagtaatattgttggaagcaatgacagatccgaatgtcacatccgatcctgtagatactgattgagctgcatttggcttcacaataatatagtctcctgtagcagatgtccccgttgaaagaagttcccacgtagaattcgttccggtaagtccggtgctcaccagttccacactctgattggctggtaccgaaatactggcattcccgttaattgtttccggagcgacagcatttacggtgatcttaaagtttgtgttgtttttaattctgtaaatccttcctctgaagtttccaaccccactgatagaagctggtaagccgaatacagcatctgaactcccattatatgaaacatggaaatctgataatgttaaattataagtggctgtagtaaccgctttataattcgcggccaatgatccgttaatatccatggttgaacccggattgacagtattgaccccaacatttcctgcctgggcaaaggcaatagccggacttaaggctatcattgcaaagattaattttgtagaaattttaaacatttatcattattttatttacattaataaacccggttgtttaacataatgtaaaaatatcagaataaattctacagaaaacatcaccatgcgtagaaaaaaactaagccatttgtagaaaattttctacactcaaaaaatagctttcattcatagaaatcggtattatgacatatagacttcatatagtttaataaggtcggccagattacttgttttcagctttttatggattctttttttataagtgctgatagtggacatctgaatatccatctcatttgaaatttccagatttccgtttccttttaccatgagcataaaaatttcatattctctttctgataaactcttgatagcatccagtgcagaaggctgcaatagtttattgacaaaaccattagggtaataattcccttctgaaaacattttcatcacagcttcagaaatagtatctactttactgagcttattgatgtacccatctgccccttcttttatatattgcacggcaatttcttcctcataagctgaaaaaacaagtattttcaaggcaggatcaagctgtttgatttctgagatcatttttttatttctgctttcaggcatattgatatccaggataagcagatcaaatttttgtctggagattttatcgagggcttcgggataatctgaagctgtatctatgagaacatcaggaatacgtgattctaaaatgatagcggttcccgttaatacaatatcatgatcatctgctataaggatctttttaatcattttttgtttttttaagaattaattggaaagaggttcctttggtctcatttcttctgattataattttactttccagcatttggagcagctgcaggatcaggtgaagccccataccgtatttctgcaataacagtttttcattttcaatgttctcctgaagcttggtataatattcaatcttatggtcatccataccgattcccgtatctgtaatttctaagacaaccgcttcctgctcatctgatccggaaatagtaatcgttccgcttcttgtatattttacggagttatccattaaattatgaataatagcagccagaatatttttactggtctgtatcattaatcttttatctacattattaacaattgctgtgttatgattggctgcaatctcatcaaaaaggactttcttttcctgcacaagatcatagaaggaataccactctgtttcatcagtcctgtattcactatatatatcagcatattctttcagcgtttttgtgaaattgtacagctggttagatgatttgtagatagaattaagaattctttctgtacggtatgcattcttttcatcatagtccaacgcttctttactggttaaagcaataaatttcaatggtgtggtaatatcatgggtaattgttccgatgagctttttctgctgttcgatttcttttcccagctttatttgtgtcatctcgagatcttccactgtttgcgacagcaccttggttctagatcgtatgactgcttcaagttcacgatttttctttttatgaaaacttgtccgccatcttacggacaaatacagcagaagaagtaacaggaaaacgataattaccttaaaccataatgtttgataaaaaaaaggaggaataataatcttaatttttttgaaaacatattcctgcttatcagaaacaagcattctgaccacaagaaaatgggtaccatggccaagattgttgagaataaacttacggtcttttcctacagacagccatttactggttctgtcatcgtccacttttgcttcaatgataatattatcaggatttgcataatatgggacatcaataaacaattcaatccgtttgttttcctggctcagattcaggatattggtaaacaatctttctttatcatcaaacaaagccctttctatatacagagctgccggataataacttttaactttcaaaggattaaaaaatacaagtccgcttaatgaaggtaaaacaaaatcaccatttttcaacttgtttccatttatgttgcttcccccattaaattcattggtactaaaaccggcttcttttgaaaacctgtagtagttcagtttaaaattcctgtcttgtacatatttcaaaagcatgctttctcttattttatacaatccattattggtaggaatccagaagtaaccattaggatcttctagcagtgtatgcggtgacaaaagattgccttccgcatcaccaggcagctttataagatggtcgttttttaagagataaaagccttttccaagcgtggttacccaaacatttccatctgcagtatacacaatatcacgaactgacaattcatttttcccgtttaaattgtagattttattatgactgacggatattctgtacaatccttttattgtacccactaaaatatcaccggattttgttaataccactttggtaggttcgatggcaaacaggtattttttctttaacgatttaaaaggccagtcttcataaatgcttaatgtacctgtgaactcggtattcccttttttttgtttcacagccagcacatagtactttccattggcaaagaaaaaatctttcacagtgtcttctccggtggaaatgctctggaaatgtataaaatcggacggtttactgtatacaaaaagagtttgttctctccgggttacaatattgccgtgtttatcaaaatttaaaaaataagatatatttttttcgaagtttttgcttttaatgaatccgttccggttataaatttcccctgccggattaatgacacatgaatcattgtaaggctggatcgcataaaaaacggctgatgattttggagtgctttttttcgaagaggtgaaatctgttaaactcactattttgagtccgtctgtactgcttccaagataaagttttttgtatttttcatcatagtaaatgctcatcagattgctttcacttatatgctccagccggaccagttttgagagtgtaagtgctccgttattggaaattaatctataaagcatatcattattaaggacaaaaccctgtccattggttctgttccagaaaactttacttctgacatctgctacaacaggcaaatcataagaaccggtaattttcccctcctctattttttttacttttttagcattacgatcaatataaaacagtacatctcctatcgtaaaggcattcggattatttttataaagtggctttacatcaagtgttatctgtgattttgaacgaaaatcttcataaataaaggaattttgtgctattaaatatctcccttttctgaaatccataaaaaaataaactcctggagaaggactgtagctgtagtttgaaatacacaaatgataattgatgttgtctttaacaatcattgttggagatctttttacaggactaattacttttggaaacttttggtgtatcaacactgtttttccatgatctcccggcgtaaaaatgctgtctttagcaggatcaccgtaaaaataggtaaaccgctgactgttcagtggaaagtttttatgaacaaaaaaattaagtccgtcatatcttacaattccattttctgtagtcagccagataaagccatatttatcttttataatatcttttacactgttctgaggaagtccgttatctgtgttgaaaacctgctccgtgtactgttgggaataaaacaagagaaaagcaaacagaaaaccaactgtaagaatatttctacgcaacaaactaatcatttttatcaatagcgtaaatataattcatttaaaacactttattattaaattatacatcaatcatacaaaaacagctgtatttttttaccagatatttccgcggagattgatatttactttaaaaaccgaagctatgttaatgtttatacttactgtctgttgcatcttgtataaaatcaatcatgtttcagaatattctaacacacacatctccagtatgtttcattaattagtatttttgaagataaaatttttaatctttattatgattacaaagaaatcaatttcatctattgtattattcttatcaatatcattatgcttttctcaaaatacagtaagcaggcagcaggctaaagatgacattgactattacagtaaaacggttttggattctcattacagccctttcctgtttatatctcaaaagcaatacaatacggaagtggataagattaaaaacaaactgccggaacagttgtcataaggaaatgactttggtgatgtatcaggtaagtgctcttttgcaggatgcccattccaatccgggcatttcccagtctttcatgaaagaggacttttccaaacccattttctttccgctgttactcgtttcagatcatgaaaaaatatattcatcagcaaatacaggacaaatacctgcaggatcattaattatcagtattaatgggaaagatattgaatctttgttccagaacatgaaaaagaatatcggcggaaccagccagttcagagatattatatcccttaaattattcagccattttctatacctggaaaatgtaaccgctcctttctctgtaagatataagttacctgaaggagacatcaaagaaattaccattaatgaaggaatgaagttcagagatttcctggctttatcaatgccgggaattgcaaagccttatgatttcaaaatcatcaatcataaactggcttatctggacttcaggagtatgtccggaaatatggatgattttgataagttcctaagtgagacatttgcaacaataagaaaagagaatattaaagatttagccattgatctccggaataacagcggcggaaattctattctgggagacctgttgctgagctatattacagatcagaaatattctttacaaggcagcaaacgctggaaaataagtcagatttataaagataaactcatcgcagaccataataccgaaagtgaatatctgaaaatggagaacggaaccgtctgggaaacaggaaattgtaaaccggattttaataaatttaaaaatgatcctgtttttaaaggaaaagtatatgtgttaaccggtccttttaccttttcaagcgccaatcttgtagcagacggaatgaagcaatacaaactggcagagcttgtaggtgagccaacgggtgaatatacgaatgattttggggaagcctttatgtttacgcttcccaacagtaaaattcaaatgcggagtacttcatccatgagcttcggtgctgactgcaatacaagtagttatacccccgtagttcctaatatcctcatagttccgacattgcaggataagattaatggtattgataagccattggaatatatattaaaaacagtgaaaacaaataaggggactaattgataatctccccattgctgttttccagtttttcacggaatcgttgcagatcttcaggcgccggtctggtccattctgtaacttccccgataattttcaaaggcatttcggagcggtaagagcgggtgggatttccgggaaattttttatcggtaacattcggatcgttttcaaaatttcctgttggctctacaatatagacacgttctttatcttccccttttgccaatgcagcagcaagtcctgctccgttaaccaaagccgtaaaatagatgtgattcattttcagatcagactggtagttggagttccctcctgccgtcagtaagtctccaacctttaaatctgcttttgttccatgataaaaagggcctttatcagacggatggttttttaactgcaaggccagttcagcattcttttctgacatttccgtatctcctgattttccgtagcactgagcaattttctggtaaagagcaggcagcgcacttttaacggtatcatcatttatctttaaagcaaaatccaatgatgtttccagccattttaactcatctgcagttgtcttttgatgacgggcaacataatgagcagccagaaatttttcgtgatcatccgttgtttcattccaggcttgcaaaaacagtcttcctgcctcttctgacattccgttttcttccatggccatgccttgcagacatagtttaaccacattattaaaaggtgagaattccatgctttatttttttatcgttttaaaattgtttcggtagatctgacaaatgtatacaaatacggtgaaacggaaagcatagtcaaaaagaactttaaccatcttattgataaagatatttttatttgatttaaaaacagactatacaagcccttttcaggaaaggccattttttttcattatatttacttaacatcaagcaataaataaattaatttctataactttttactttcaaatgaacgaaattaatctagtttaatttcaatacaacttagccttattacatttgctaaagaattaagacaacacataattacaaaataacttaatcatcaacattaaaaatttaaagctatgagtacattaacattaaaagacggaactgaaattttttataaagaccagggagaaggacctgtactgatgtttcaccacgggtggccactatcgtccgatgactgggatgcacaggtgatctttttcttacagagaggttacagggttattacccatgacagaagaggccacggccgctcaagccagaacatttataatcatactattgaacagtatgcttctgatgctgcagaacttgttgagtttcttggtttgaaagacgttgttcatataggacattctaccggaggtggtgaagtgatccgatatgtacataaatatgctaatggaagagcaaaaaaagcagtcttgatcagtgccgttccaccggttatggtaaaaagtgaaacgaatcctgatggtgttcctatggaagtttttgataatatcagggaacagaccatgaacaacagaaaccagttttattatgatctgacattccctttctatgggtataacagagaaggtgccaatgtaaaagatggggttcagagaaactggtggagacaaggtgtgatgggtggaattgttgcccattatgacggtattaaagcattctctgaaacagatttcacagaagatctgaaagcagttgatattccggttctggtaatgcacggagatgatgaccagattgtccctatcgaaaattctgcgataaaatctgccaaattattaaagaacggcaaactgattgtctatcctggtttccctcacggtatgccgactacagagcatgaaacgattaataaagaccttttggaatttattcagtcttaaaaaactatacataaaaaggtggactgaattgtccaccttttttcatctgcatatttgtaaacaataaaaccgctctaaaagcggtttttattctgttatctcttttctaaaacaatctgttatgcagagatcttagggcttctatcttataaacagatggaaccagtaatgaaatattattttcacttcctccataagaaatcatacggatcggaatatgctttaccgcttcagagacaatagttgcgtatccgtgattttcttttctgaaatctccgacaatacagatgatcgattgctcattgtcaatttccacagctgagaagaactcaagttcttttacaatttcagacagctggtctgtctgatctatggtaagagaaacagctacctcagaagtcgtaatcatatctatcggagttttataacgttcaaaaacctcaaaaacttttctcaaaaagccatacgccatcaacatacgggaagactggatgcggattgccgtaatcccgtctttggctgcaattgccacaatctgattctgattggaaatttctcctgaaatcaatgttccggccgcacttggattcattgtatccagtaatcttacaggaacattatattttcttgcagggaaaacactttgaggatgaaggattttggctccaaagtaagataattcggcagcttcatcaaagctaagtctggcaatggatttggtattctgaacatatctcggatcattattgtggaagccgtcaatatctgtccatatctgaatttcctctacctgcaaggctgctccaagtaatgaagcggtataatctgatcctcccctttgcagattatcaatttctccctgagcatttctgcaaatatatccctgggttataaataaggtttcttcctgatattttgctatttcaagaccagcatgttttctgatgtaatcaatatccggttctttatcttcatcaatcagcataaaatctaatgccgataacagaacagaagagatttctttttcttttaaatgtaaatgaaacagagttgttgaaataatctcaccctgtgccaatataacacgctctgcactggaagtgaagtttttatttttgaattgataaaacagatcaaagattttatcaataaaagatgaagcttcctgaataccttcttctgttttaaataatttatttacaaagtttttatatttttcatatagtacatcaatatgtttgtaggctccctcaatatccttcttctcatacagttctgataactttaccagatcatttgttgtaccggatactgctgataaaacaaccaggtgtttatccgctgcctgagatctgataatgggtaataactgttcaatcctttccgggcttcctactgaagtccctccaaattttagtactttcataatttattaattgttaaatatttctcaaaaaaaaagagcctgtcgtgatgacaagctcctgatttattttagtttctaaccaaaggaaaatgactcacgacgttcgacgtaagtactgtttctttcccttttttaagttagataatatcattatttctttttttgctgggcaaatatacaaatttttgcaaataaaaaattaatttccgatattttctttatgatgttacatttcccatcctatcagattgttgataagatacttaagcattagattttcttttttactttattattcttatggttttaaatcttcaaattgtttgtcagcaggaagaatgtgctgtactttttcaactgataattcttttgcaacttcaaattcggcggtctgcctgatatccagcgatgaagctcctaccagaattttatacgttccggcttcagcaatccaggctgattttcccgtttcaaacgaagctaaatctttcttgcttaaagtcaaaataacagtctgggattcacctggatttaattcttttgtttttgcataagcttttaattcagattttggtttgtcaatggtctttccaggtgcagaaagatataattcaacgatttcttttcccggtacctttcctgtatttttaatattgacacttacttctattgaattattaaatgtctttgaactggttttaatatttgaatactcaaaatcagtatacgactttccatacccgaattcaaacgaaggttttattccaaaagtattaaaataacgatatcctacgtaaataccttccttataagttacctctgtaggattatccgatggttcacccggaaaattctttgatgatgcatgatctgaataatttacaggaaatgtcattgtcagttttccggaaggatttactttcccggaaatcacatctgcaacggaatgccctccttcctggccaggctgccaggccaataaaacagcatctaccttatctttccacgaagcagtttcaatcaccccaccaatgttcagtatagccaccactttttttccttttgcatggaaagctttggaaattttatcaagcatttctatttcctcattggccagattaaagtcattgttcaatactctatcccctccttcaccggaatttcttcccaatgttacaaaagcaatttcagaagtttccgcttttttagcaatgaaggcatcatccattttcatttctggaagcctctccggcaaagctaaaattccccgggcttttctcctttccttttctgctgcagcttctttttcagcatgcggtttatacaattctaccagctccttgtctaatttataccctgcagcattcagtccttccaaaagtgaaaccgtatgtttattgttgacactgccacttcctgtacctcctgtaatccacgcataggaagtcactccaaacaaggaaacctctttctgcctgtctgcaaaaggtaaggcattgttttcatttttaagcaacaccattccttctgctgccgcgcttctggttactgcagcatgtgcgttcagatccggtcggtcactatatttatagtgtgcaaatgttggtgtcccgaaaatatatttcaaaattctttttacgttcagatctgccacctcctgtggtaaccggcctgaatccaaagcttccagcaatacctttttctgtgccggaattccaggcatcaaaaggtcatttcctgcattcatctgcttgactacatcagaaattcctcctgttctgatggattcaaatccgggaaagccaccgaaccaatccgtcattacaatgcccctgaatccccattcgtttcttaaaacctgagtcagtaaatctctggaatctgaagtatacactccattcactttgttataagatgacattacagtccagggctgggattcttttacggtgatttcaaaatttctcagatataattctctcaatgctctttcagacacatgtgcattgattgttaaacgattggtctcttcattattggcagcaaaatgtttgacagaagttcccactcccagggactggactccgttaacaatagccgcagcagttttccctgaaattaagggatcttctgaataatactcgaaattcctcccatttaatggatttctttgaatattcaaggcaggcgccagcaaaacatcaacaccatattctttcacttcattacccattgcttttcctacctcttccaatagcgttttgttccaggttgaagccaaagcggttcctacaggaaatgccgttgcatagtacgttttggaatcattttctctggttggtgcaattcttaagcctgcaggcccatccgcaacaacagtagccggaattccgaatctgtccagattcgctgttcctcctgcagctccgggaaccagccctttttttgtgtctcctacaggtccggttaagacttcaattccgggcattcctgttccaaccaacagatcaaccttttctttattggtcatttggctgatgatagcatcaattctttgatcaaccggaagtcttgtatcttcccagatgtccagtttaccattcttgttgagatctgtgaacgtttttccaccaacggtaattgttggactattttgagcctttgtaaggggtgacacccccattaaagccaaaaacaataccgaatatttgttcccggaaaaaagtccgatcagtgttgatttattcttattcatatttagatttagtttttattaaacagagcataagcttgaaatatgctattctaaaaaacacagcatattctgccctgggacagaaaatgccatgaaagaaactatataaaaagtattaaattgattaaataactacaaaaagttatggaatctcagccagtcaagatatacatcagaccatttgtcgacgggtaaattctgttttcccataccaaagccatggcctcctttttcatagatatgaagttcagcgggctgcccagcttccagccatttgttatacaatacaactgattttggtgccagtttcagttgatcatcacttgcggcacagataaacattggaagaacagctttaggaacttcggtatttagaatttcctggcttggtccgccataaatggatgccgcaaagtttggcagcgttgaagcatctttactatgcaggacactctctaaaattacactggcaccagcagaaaatccgatcactccgagtttttcaggattgatctttagttcttttgcgtgcgttctgatgtatgagatggcagttttgatgtcctctccagtcatcactttaacaggagctgttttggcatcaaaagcatttctgtctttgatattctccatcatttctttggcagggtcattggacttcgtttccagcagtctgtattttagaacgactgctgtaattccgttttctgcaagcttttttgccagatcaactccttcgcggttgatggataagctttgaaaaccaccgccgggagcaataacaacaactgttccgttggccctggttttatctgcctcgaaaaccaatattgaaggctgagacacattgaaaaccacttccgttttgaacagctcactgaattgctgagcttctttctgcttccagttttctgttcccggtgcctttccatgatataaaggaatagatttctgtccatatgcatggtatattcctgagatgaataatgcggttatgaatattcttttcattttcaatttgtttatttaaataactgaggaagaaaatcattcagataggttctccaattgctccacgtatgaccgccttcggattctacgtattgatatttgaagttcatcttattgagtttttcacggtattctgtcacgtttttgtagagaaaatctgttttcccgatggcaatccaatacaacttgtacgaattggtttgctggaccttcagtttttgatctaaattctgataaacgggacttttcttttcatcaggcggaagaattgccggagaaaacagccctacataatcaaatgttttcggcagattggcagaaatatacaaggaatggaatcctcccatggaaagtccggcaattgctctgtttccggcgtctgattttacccggtaattgtgctctgtaaactccatgatttccttgaaatagttttccatatcaccgctgaaaatatcaggtgttttcatatcgattttataaaaacctttcgaagattcgcccggcgcggctgaattgcttgtatgaccatttggcattataacaatcataggttttgcttttccctgagcaatcagattatccagaatctgcgaagctcttcccaaggtcatccatgcttcttcgtcaccccccattccgtgtagcaggtataaaacaggaaatttttcttttgaattttcatatcccggaggggtgtacaccgttaatcttctgtcttcttttaatccgcttgatttgtaccatcttttggaaactgttccgtgcgggacgttctgaaccttgtaattttcagattgttttccatcaataaaaatcatactcatcactgatgaaacatcacgtacctgataagaattgttcgggtcattagcttttacaccgtcaacaataaaagaataggtatagatatcaggggccagatcatcttgagagaaggaccagattccatctgcacctttttttaattctacggttcccggctcccagccttttcccggcatccagtttccctggagttttactgttttcgcctccggtgcacgaaggcggaatgttacgtttttacctttgatctccggtgaaattatttctttctttccgctgaaatcaaggttttcctgggcaaacattaatgaacccagcattaatgaatagattgtgtatctgattttcatattaaatggtttttaccacaaaaggcaaattctgagcctgtaaaatacagacccagaattatcaattactttttatatttctctgttcttgcatctttaatcacaccggaccagttcattccgtatccgaaatcatagttatggccttcagaatctttatgggtttccatatcgtaaggaacatcttctttttgcttttcaacagttgccatattcgcaggcatctgaagcggaagtaatcctgatggttcgtattttccggttacgatatctacaatcgcctgattggaaacattaaagttcatcagaatggcatcagcatgtttttcaaattcgttgaaaaccatcggttttgaagctgttacagaaacaatgacaggttttccgttcattgccttgtacgtattttcaatggtcagcagatctgtaaagttggtagcggttgatgttttatttctgaatgtcctgtcgtgtacattcggagctacaaccgggtcacctgctgcaatacttttctcacgggcttcagttgctgtataggttttgtattgaagagaaatcggaagatatccgtttcctccttctgcagcatcaatatcgctgtaaccaccttcttcactgtgcggacttttcacaaaaaccaatgcgaaatcggctttagaaggatcttcggttacgttataatgctttttgattttttcgatgtcaacaggataatccagagaaggagctgtgtaaattccccaccagttaaatgttgccggagaatatctcttcggaatataaaccgtttttctttctttgataggaagaatattggatttatttttcaacatcacgatggattttacctgggcctcataccccgctttcataaattcaggattaccaactattttttttgtttcttcaatgttgacgtaaggattttcaaacaatcctgttctgaagaaatttcttaacaaacgaacggcagattgttcaaattttgcacgataagctttttcaccatgttctttcactcccatctgataggcttccaaaacaggtcctttatcattatttcctccgaattggtcaacaccggcttccagcactttatagtgacgttcggcaatggataatttctcagcgccccagggtttacctgcaaatcctcccggagttttgggttcatcagcggtaatcagccagtcggtacagaccacaccatcatatttgtattttccacgaagtaagtctgtgatcagatatttgctgtaaccgtttccgacattctctccgtttttcgtatcctgattaaagctgattgtataataaggcattaccgcagaagcttctttggttcctccgtttaatttgaaagcaccttcagtaaaaggttttacgtgattctggaagttatttcccggataaaccgcgaattttcccattgcccagtgcccatcacggccgccttcttcagggccgcctcccggccagtgctttaccatggcattcacacttttattaccccaaccagttttgcttccgatggttgtctggaaaccgtcaatatatcctcttcccaaatcagctgtcagttccggactttcagaaaaaacgtaagcgattctgtaccagcgaggctctgttcccaggtcgatttggggtgataaagccgttgaaattcccaatgccctgtattcctgagcagcaatatttccgaatttcctgaccagttccggatcaaaagttgcacccattgccaggccatccggccaaagtgaaatctggccgcctgctccttcattaaactcagcggttacggttgcagaatgtctcgggtctgtactgttattggctggaattcccaatcctaatccttcaatataagcctggatattgttgctccattgtgctgcaatttcgggagactcaacagttgttaccaaaacatggcgcagattatcttcttttaagaatttcttttgctggtctgttaagtccgaggcttttgccccgctttctttatacagctttccgttatatttacctgcccggaaaccgtctgcaggcgcaggaacagactgatggccgctgtacagcattaaccctgcaatttgttcgacgctcatttttgaagccaaatctttcgctctttcgtcaacgggaagtctccagtcttcgtattgatcaagctttccgtttctgtttaaatctttgaatttatttcctccaattgtaagaattttcacccctgaatctgcagaataccctaaaacaggacctttgggattcgtcaccatctgaatattctgtgaaaatgctgttactcctaaaaataatgcagcaatatttaaaaccgtccttttcattgtttatattttagaaattgaagtttactgataattggcctgtcaatggcataatgtacgttcctgtcaacagttttccgtaatacggacttgcatctgtaatcaattcagctccattgatagttccactggctcctctttggttcaggaagttgattaccgttgcacctatgttaatgtttttgtttacggtatagcttactcccccgaaagtttcccatctcggtgcaaaatatagtgcattggtaagattcgcatattgtttggagaaatatctgaagctcgcccagaatctccacttgtcaatagaataacttggatcgatttccattaaaactttagcaacccctaatacattgttgtcgttatagtcataatcttttccgaatgcattgaaattaaatttcttatacacaggattctggaaagtaaccagataatgtaaattaaatcctttgaatggttttaaaacaaaatccgtagtccagcccagcgtctgaatatcataataaacggttgtggtttgtgcctgagagctatttgcaggatttaccagattatatctgttaaggttgttatttttcttcaggtaggtagcctgggaaatcaactgaatccagttggtattccagaaaactccgaatgctcccaacggacttttaattttattggtattgggttcaaaagcctgggaataactttccaatcttctgttttcttctgtgtacaggaaattggctaaaaccccgaagttcttggtgatgttgtaagttgcgttcaaacttcctgcaatctgaaagaaactttgactgatatgattaaactggtcaggatctgtaaaactaaagccaatagtccttggagccaaagaatactccccgtcgatgatgtgatttcttaaatgtaaaccatagctcagattaaagttgtcggtaactttccattcatcaataccatacagtgaaaatttattctctgttccgctatggtattctccgcctgcattgtaattgtaaaaaccgtcagaatcagtattcggaccgatcaagcgttgaggctgcggctcaacagtctggaagaaaaaagtacggttggacgtatatttgttgacgtgataatattgctccaacgctccaaatgtcaaattatgatttcctacctgcttgttcagagaaaaacgtcctgcaatgctggtaatcggggtttccggtgtatacattcctaaagtagttcctacctgccctgaataagcctggccgttggaagccaaagtatatcctgctgaagaatctgcattgaaaatacttaaaggaatcatattggacattttcacttttgaaaaatgtgctcttgttgagaatttgaaattccatccgttgttcaaaagataattaccaaaaatatcaatgttatgagatttagatctgttatcatctccactcatagatgcccaataataatttcctgtaagaatatctttgactttcatctgtccgtctcttactacataagaatctcttccaattttgaaattatcaagctctgttacttttccgttttccccgtattggaaaacagcataattggttatgctatacgaatctgcatatttgtagagtgcggtgatctgtcctttattgtcgttaaaatacttggtcacgcctgctctgaaaatttttgtttcatcagcatttcttgcaaatcctaatttataggtgctcggatcatagttggcaaaagctcctgcggtatacgtccagccatttttggaaattggacctgagacattgacatcaccctgtaaccagccaaaattgctggtggtaaatttgcctttgatcttaaggtcttttgttcctgtctgcgaatatgaattgactgcaaaaccaagatctcctgtcgtattggccaactggtccatttttaaaagtcccgttctttccagtccaacactttgcctccatgttttattgggcagttcgggccagaaaaaataaacaactggcagatcattttcgagaatcgtaattcctccaactgtagaaggaagaccaatattgacatcacgagggctggtattattggcagcattgagcatgacattcctgttgttgtcttctttggaggaagtgatcgcttttttctttaaagctaagctgtcggcttgctgtccaaatactgctccacaagaaagcatgagcagtaaagtggaaattcggagttttgagtttttcataatgatcaattaatctgttttttgtttgggttgtgtaatgaaatgatgaatttcagatggataactgatttaaaattaaacaaatagctaactggattttatccttgtaatttttgacatcccgtggtatttttagttgcttcataatgaagcaactcaatattacattctttttctgatacagccaaataaatgttaaaaaaatattaacattatagtaaataattgattattaataaattataatcaatgaaatcaaaataaaatgataaaaagaccatttatttacccggaattgtaaattatatgttaccaaaaagcaatgctaaaaagcctgaatgtttgcaccttccttaatatcaccttaactttgttcagcgagaacaattaaaataaatatgaaccctcatcaacagattttaaaaaaatcaacagaagcctatcagttatatcttcctcatatttctatcgatactgtcatcttcggattcagtgaaaacgaacttaaggtgctggctataaagatgaagtttaacaaacaatggtttctgccaggtggctacctgaaaaaagaagaaaatattgatgatgcagcggtaagaattttaagcgagcgcgccggtgttacggatatatttctggaagagttttccgtttttggtaagaatggccgaagtgagcaagttttcagtgattatgatgacagcttgtggcataagcaaaggtttatttcgattggttattatgcattggtaaactatcatgacgtttctccaaaagcagacgaactgagcgaagaatttgaatggctcgacgttaataacctcgatcattatcagattactatggaccacaaacagattattttaaaagctctgctgacactcagggaacgaataacctacaagccaatcggctacaatttactgcctgaaaaatttaccatgacagaattgcagcgattgtatgaaacgatattaggaagaagtctgaacaggggtaatttctacagaaaaataaagaacctgggaatcctaaccaagcttgatgagcaacgcaaaggaggtgcccataaggcacaagatctctattcctttaatcaggaaaattatgtaaaggcactggaaaatggagtgaacagctggtaacgatgagaaatatatgtgaatagtaaacacaatataaaatcattaccagaagtttttctggcttgcaatcctgtttcctgtttttttaagtagattatgcttcgtctttggtatttttgacaagccctatcccggaaaagaagaatatgagtccgagaactcctataacgcccaatgtggtgtaagcagcacttttattgatgagctcatatccggtataaattaaacctgcaattcccagaatagtcaatatagttccaaatgttcgtttaacgttcatagccttaattttttattgttaaaaatctagtttaaaatttgttttctttatatagctccatcagaaactgatctaaggtatttttttaaattggttccttatccccaatatagatttcaaatatccttctgtaatagagtatttgtttctatgaatatatcaaaccaatacattacatgtaaaaaattgcaaaaaccaagccgtttagtgaaaaatatactttttgcaatacaataataagtttaacaatatgcaagccagattctcttacatttacattattttccatcagttgaaaatttaagcaggtaccacactgcgacagattttggccggatgtttgaaatgatattacaggtttcgagattttcagtagaatgtaatcaacaacatgtatggtcattatcaatagttttgaagaatataaggcatttgaaggtaagctaatcggtgtatcggactggcataccattgatcaggagcagattaataaatttgctgatgcaacattggaccatcaatggattcatatcgatcatgagaaagcaaaaaaagactgtccctttaagtcgacaattgcccatggctatctgactctgtcacttataccctatttatggaagcagatagcggatgtcagaaatgtaaaaatggaaattaattatggcatcgaaaatttcagatttgggcaacctgtccttgtaaacaaccgtgtacagctgcaagcctatgcaaaatctatctgtaacctgaggggaactgtaaaagtgattgttgaggccaaattaattattgaaggagaaacaaaacctgcctatgtgggtgatgttttatttctttatcattttaataattgattagtcaatggggtattttgttcatttacataacaaactataaaggagttaaaaatgaattgatgtctattttcatttgtatagattggggcattaaaaaaatgcgatgatcgcaaaaaatataaggagttgtaatgttaactaattacaactccttatattttttaagcgtttttcaaaaatttttatccttcacgctcagtggagaatacgggattcgaacccgtggccttttgactgccagtcaaacgcgctagccaactgcgccaatcccccgaattatttaagcgatacaaaagtaagtatttaaatgaaatctgcaaatatttatatctttttattgaataaaaagaaaataaaataataagtaacagcaagaagttttctatttctcgttggatagtacagataagattgacagaattaaataccaaactcttgcattagaaattgctgtgatctcttttaagtccaactacttatatcttatttccttctactttttgtcttcttcacaaaattctaaatcttttacttgtctgaagtgataataaaagttatttaaaaaatcaaacaattacaatagtaaaaatttatactttattttaaataataataaaataaagtactaattttattgcaaataaattcagttatgcaagaaaaatccaataacacaaaggaaaaaatagttgaactatacggtgactatcttttgaaatatggagaaaaaccgaaaaacatttatctgttcgctaaggaaaatgattttgaagaaaaagaattttatcactatttcgcggggtttgaacaaattgaaaaagaaatactgaatcatcttttcacaaaatcattgcaactttcttctgaaatcaatttttcagaccagttggctaccaaagaaaagcttctgaatgtctattatattttctttgaaaaccttaccatgaaccgctcattggtattattgattttaggaactgataaatttcaaaaaattaaggtgcttaatagcctgcgtgaaacgcataaggaattcatcagtactctggatttcgataagtgggaaatcattgagaaagcgaaacaagatattcaaaaactcagcgaaaaaacgagatatgaagctctttggcttcatttaatttcctcttttgagttctggataaaagacacttcccctgattttgaaaagacagatattttcatcgaaaagactatcgatacaggtttcacacttatggatagtgaaccgttaaagaaggtatttgatcttggcaaattcctttggaaagaaaaatttaccataagctgatgatagtttttattctcctggcttttaataaaggcgtcagagaaacagctgtaaaataataaaaaaatacctgacaaaaattaaaatgaaaacattagataaaattcccacaggaaaaattgaacgcacgggcagcctgctgaaagcaggtgcgaaagtgggtgtcaactacctgaaatattacggaaacaaaatcacgaaagatgaaaaaaaagctcgtaaaattctgaatgagaataacgcaacagatatttacgattctctgaaagaattaaagggctctgcccttaaggtggcccaaatgctgagcatggaaaaaaacattcttccggtagaatatgtagaaaaattctcgctttctcagttttcggtcccaccactttccggtgctcttgtgaagaaaacatttagaaaatattttggaaaaaatcctgaagatctatttgatgcgttttcttctgaatcagtaaacgcggcaagtataggacaggttcataccgcccgaaaaggtcatcagaaactggctgttaaaattcagtatccgggagtgagagaaagtatttccagcgatctgaaaatggtaaggcctatcgcaatgaaaatgttcaacataaaaaaagaaggttctgaatcttattttcaggaagtagaagacaaattgttcgaagaaacggattataatctagagcttatcagaagccagcattttgcggaagaatgcagccatcttccgaatttaaaatttcctaattattatccggagtattcttgcgagaaaattattacaatggactggatgtcgggaatccacttttcggaatttaccggaaagaacaactctcaggatgatctgaacaaaattgggcagacactttgggatttttatatgtaccagatgcatattctgaaaaaagtgcacgcagatccgcatcccggaaattttctgatttctgataataaggaagtactggtgattgatttcggatgcatcaaagaaataccggaagatttttacattccctattttgagctggcaaaagaagaaaatcttaaaaaccctcagatcttccgtgaaaaactatatgcattggaaattcttcggcaggaagattcatcacaggaaaaagaattttttgcccaactgttttacgaattattggaattatttacaagacctttcaatcaggaaaaattcgacttttctgatgaaacatttttccgggaaattgccgatctcgggcaaagatataccaaagccagcgatatgaaaggaatgaataccaatcgaggttcgagacactttatttatctgaaccggacgtttttcggtctatataatatgatgcacgatctgaaagccaaagatgtggtaattaatcattatagaaattatttaagaccttgaaatatgccagccaaattaccgtccaaaatctgtgaagtatgcggattgccattcaactggcggaaaaagtggaaaaaaaactgggatgaaataaaatattgcagcgaaagatgccgaaaaaacaaaaaatcaacatcctttggttcaccaaagacctgagaacccgggattcggaatcattatacaatatcatgcaggaagatctgccttttcttgcggtgtttgtttttgactctgatctttttgcccaaaaacaattcggtttcagaaaaatcggaaagtacagaacccggtttttactggaaagtattgaagatttaaaacaaaaattagctaaaaaaaatattccgttgttggtacgacaaaataaaacggaaaatgtttttgaagaaatagctaaagattttgaaatcgtaaaaattttctgtcagcaggaatggacaaaagaggaaaccgaccttcaaacgaaaattcgaaaaacggttccctatgcgttttgggaaaaatcttattcacagtttttactgcatcctttttttgtctgtaaagtgttggataaaattccggaccttttcactaccttcagaaataagattgagaaaaatctgctgattcgtccagaatttgaaacggaacagctgatttgttataaatctgaaattcatttcgaaagcgataaaattacgctccggtctttaggttttgaagattttgaaacagatgcaagaagtgcttttccctttccgggaggagaaactgaaggcttaagacgtttacaatcctatttaccggaaacccaacatctgagcaggtataaagaaacgcggaacggcctggtggggacggaatacagttcaaaattttcgacatggctgtcctgcggaagtctttctgctgtgacaatttatcacgaaatcaaacgatttgaaaaaaagttcggcagcaatgagtcaacctattggctgttttttgagctgctttggcgggatttttttcgctatgtttccttacagcataaggatttgattttccgaaaaaaagggattacccatagacaatattcggcatcccatcatctggagcttatccgaaaatggaaaaatggagagacaacctccgattttgtcaatgccaatatgattgaattgcaaaaaacaggctggatgagcaacagaggaagacagaatgcagcctcctatttctgcaaaacgctgaatcaggattggagaataggggctgcttattttgaggaaatgctgattgattatgatgttcacagcaattacggcaactggatgtatctcgcaggagtaggaaacgatagccgcgaccggacttttaatccggaaagacaggcagaactctatgaccccaaacaggaattcagaagactatggctaaaagtttaaaacataccgctcagctaatttttcctcatcagctttttgaggacacagattatcttatcaaaaatcaacctgtatttttggtagaagaattcctgtttttcaggcaatatgcctttcacaaacagaaaattgcctttcatcgtgcaacgatgaaattctatgaagactacctgaaaaaatcaggatttgaagttgaatatattgaaagttcctcgaaatactcagacatcaggaacttaattcagaaacttgaaaaagatcattttaaaacgatacaaacaacagatgtttgtgatcattggctggaaaaaagactgaaggaaacaaaactgaacctcgaaatgccggacagtcttctttttataaatactcaagaagacctgaaagattattttgaaggaaagaagttgtatcaccagaccgacttttacaagcagcagagaatcacccggaatattctgatgaaaggaggaaagcctctgggtggaaaatggacctatgatacggaaaaccgaaagaagtatccgaaaaataaaaaagcacctttcatacatttcccgaaaaacaatgagtattatcaggaagcgaaagcatatacggaaaaatatttctccacaaattacggcacccttactgatgaacagctctatcctaccactttcaaagaagctgagcaatggctggagcaatttctggaaatgcgttttcctgaatttggcatttacgaagacagcatcgtagaaaaagaatattttctgcaccatagtgttctttctcctatgatgaacgtgggacttttaacagcagagcatgttttggaaaaagccatttcattcgccagggaaaatgatattccggtgaattcggtggaaggttttgtgagacagattttaggatggcgagaattcgttcgtggtgtttatcttcatcagggtgtatatcagcggaataaaaattactggcaacacaagcagaaactcccggggtccttttataccgcccaaacaggaatcaggccggttgacagttcaattcagaaaattctgaaaactggttatgcacatcacatcgaaagactgatgatttttgctaatctgatgaacctttgtcaaattgatcctgatgaaatataccaatggttcatggaaatgttcattgatgcttacgattgggtaatggttccgaatgtatatggtatgagcagtttttcagacggaggtaaaatgagtacaaaaccctacatcagcggcagccattacatcaaaaaaatgagcaattatcccgacggggaatgggccggccaatgggatgcacttttctggaacttcatcaatgataacaagaagttttttgctaaaaatccaagattgggaatgatgctgagaacgttcgaaaaaattcctgaagaaaaacagcaacagcatataaaaacagcaaaggaatttattaaaaatctgaaataatgaaaaaaaatttcaacatacaggaaacagaccggattattgagatggcctgggaagaccgtactccgtttgaagctatagcatttcagtttgatatcagcgaatccgaagtgattgaactgatgcgtactgaattaaaagaatcaagttataaactttggagaaagagagtgaattccggagtgagccaaaaacacctgaaaaaacgaaaccaggaaatcaaccgctttaaatgcagcagacaaaggaatatcagcaacaataaaatttctaaaagataatataataatcatgaaaaatataatcatcgtaggatccggaaagggaattgggctggcaacggcaaaaatcctctccgaacaaaataaaatcataggaatttccagaacggaaaatcctgaactgaatcatcctaatatagagttccatcagatggatattctttccggaaatttagatgaaattacttttcctgaagtggtagatggattggtttatgctcccggaagtattaatcttaaaccgtttaacaggctctccatagatgatttcaggaatgattttgaaattaatgttgcaggagccgtgaaaataattcagaaacttttgccgaatcttaaaaaatctgagagtgcttctgtggtactcttcagttctgtggcggcgaaactgggaatgccatttcatacttccattgcagccagcaaaagtgcagtggaaggccttaccaaaagtttagcagcagaatttgcaacgcagaaaatcagattcaatgccatagctccttctttaactgatactccgctcgcctcaaacctcttatctactcctgaaaaaaaagaagcagcagctaaaagacatcctcttcaaagagttggaactgcggaagaaatagcggaaatgactgcatttttggtatcagataaatctccctggattaccggacagatttttggaatagacggtggtatgggaagtataaaactttaagataaaaagatatatttttagagtaaatttgtgccatgaatactgattttttcattgatctgcttcaccaggtaaaagaatttgaaagctctgagggctgtacatctcatccaaccgttgaggatttccggctttggatgaatgatcaaaaatatagaaaagaaagtccgaccaagcttttcaaaaacgaacagcatacggtatcctttaccgaaaatgaaatctgcaaacaggtcctgctcttagcaagatattctaagcagctcgtcagaaaaggattgaatgattttccggaattagccaacgaagaattcacatacctatatcgactgaaagatgagcccaatctgactaaaatccagcttatagaaagaaacggacatgaaaaacagaccggcacccaaatcatcaaacgtttattagaatacaatttgattgaagaaaaaaatgacagtgaagacaaaagaagtaaacgtcttaacattacaaaaaaaggagaagattatttccatcgctctatagaaaaagtaaatatgacttcaaaagttcttaccggaaagcttgacaataatgaaaaaaaagagcttctggaattgcttagaaagctgaatgattttcatgccaatctttactttcaatataaaaactccagcattgatgaaattactgaagtattttaaatagaacgggttctgaaatttattttctttatgatatgatttgtcaggttagattgtacagaaaaattaattgaactgagctctatattgttgaggactttgccgggtttttaatttaaacaatcggctaaaggattgaggctgttcaaaacctaattcgaaggcaatttcagaaatactaagatctgtggcagataacaaattctttgctctataaatcattttatcgtgtataaattgctgagtgttttgacctgtaaggtttcttaatagatcacttaaatatccaggtgacatatgcagctggtcagctaaatagttgacagttggaattccagcattcaggactttatcactgttaaaataatcttccaacaactgatcaatacgatcggtaaaactaggatagttttgttttcgggtcagaaactgcctgttataaaatcgttgggcataatttagcaacagttcaatctgggaaatgatcacattatgactcatgtcatctatacgattttccagctcttcttctatatctctgaatagcgacagaatggtttctttttctttggccgaaaggtgcagcgcttcattggcagcatatgagaaaaagtggtactgatggatcttttgtgccaatggatattgcagtaaaaaatcaggatctataagcaaagtgatctgcggactgagtattttttgttccgcagtttcctctttgtccttctcttctattgaagaaagaatttgctgaggagctacaaaaaacaaaccaccctctttaaaatcaaatttagtctgtccatacattaactctcccccggcatctggtttaaaagctattttataataattcaatacatgcgatttattaggtgcacggcctgtcagaggcttgtctacgccatttaacaaaacaattaaagggtgcttcggaggcggaaaaccagaggcctccataacatcggccagcgaattaaatctttttacggaatgatttgatttttttgaagccatggtataaaattctagattacaagttaagcaatattcgctttcccctgcaaaaagaaaagcgaatagaacggaaaggttgttaaaaactgcatagatcattaaccttgtgccgccactgaaataggtttccaggtttcccattcctgaattctttctgaatagatctgttggatatgtggcaaatcatttttacccaacagcaatctaagtggtgggttttcagcatctacaacagcaaatacagcgtcagttgtggccataggatttccccgttccagcttttgcaaatttttcatcagctgttttttcaaatcatcataatccgatagttttttgctggcgatttttagtgattcggtactgccaaattcagtattatatgcccccggttcaatcagcgttactttgataccaaatgctgcaacttctttagctaagctatcatgaatagcctcaaaggcaaactttgaagaacaataatacccaataagaggattactgtaaatgccaacggcgctggacgttcccaaaatatggccataaccctgcgcccgaagtataggtaaagctgcctgaatcacatgaaccggtcctataatattggtttcatacaaggcttttacctcatcggtgccactctcttcaattgttcctaccaatgaatatcctgcattattgaatacaatatctaatcttccaaaatattcgttggccctggtaatagcattttgtacttgggaaacattggttacatccaattcaagaatcaggacctgatcgccatatgtttcttttaatgtggcaatactactgatatcacgtgctgtggcagctaccttgtctcctcgtttcaaagctgcctctgtccatatttttccaaaacctcttgaagatccggtaatgaaccaaactttttctttctgtctattttccattttttaattgtattaatattacagcaaatttggttctaaatagacgtacttacgttgctaaaacaaggattttcctaaccaaaacgaagaaatgcgaactctacggagaaaagaggatttcccatgatatctaaagaaaaactgtttgaatccaataaaaagaactcaaacagtttacatttagtactacgctcctctgttatttgaatctaagattcagagaaataatatctgaactcattcctacagattttgtataatgaccatacctgatctccagcatattcagacgttctactccaaacaatccgtttttaggactcagcctgattcctgctccataaaaattactgttaaaagtagacagatcataattgcttgtataataatcatcaaaagctgtgtgctgttcataaggtgcaaaatattttgtccctttttgtgaataatacctatagaacgggcttacagaaacgaaaggtgatatttttaccggagtttcaatattgaaggtattggatctgatgccccagctgtctgtataataccggtaatacgtcctgaatataaaccggtctcccagaaaataattggcgcgcactcccaatggcagtttgaatcttttatccgggagtgtttcctggtgcacagaaccatctgtgaaatataccctatggaaaggcagacttagaaaacctgtctgctgtacagcatccgtcagaaactcaacctgaaaattctgattgataatctgggaatatgctaaagacaatgcaaaggtatttcgtccgctcgttccatagttttcgtgctctcttcctgttgaatttcctgtacgtaattctataggtgctatcagttttacctgatcaagataggtctgaaactttgcagtaaactcccccatccggttggcggttttctgagcaaaaccaatattagccccgtaagactgatagtcaaattctgtagaaaaagagagccctccgaagatggtacttcctttactttcattctcacggctccactgaagtgatggatatattctggtatctgcatgagaggccgaagaattggctttaagatcaatcatatctgatgaagctgaggtataatgatctacaccaacactcagattgaatttatttttacgctgcttactatcatattttaccatcgtaacatcaatcgtattggaaagatcagtaagcttctccgaacccgttcctccagtcaccgcagaattatttccatcctgatggtaatagctggatacaaggttggcttcatcaaaacttagttttttggacggtgctgtattgatattttcctgtgcattagcgcttaggaacccaaagagggtccatatgcttattacaatttttttcatttctgatttttatcttatatattgtaatacactcaattacacccgcatccccctcctacttttccggaattagcacctgaggagccttctctgtaagactggaaacttaactctgttttttctatagtcctgttgcccaatgccatttcggcatcattgagctttcctttttcatattctttcaaagcggtacaggagtgggcaagcattataatacctgcggccaccagaccgattcctaatttttttatattgtttttcattgtaaattaatgttttgagatgaatagactgtattgtcatcatcgataatgatacattccagctgatgaatctgattcaccagatccagcgctgcttttattcccataataccgacaggagttgccatggcatccgctatttctgcattcgggcagaaaatagtgacgcttttaactcctgagacaggcattccggttttgggattgatggtgtgagcatactttttgccgttgatcatgacaaatttttcgtaatttcctgaagttgctacagccatatctgtaatgttcatgtaagaaaacggctgttttacatgatcgggatctgcaattcctactgtccacggttttccgttgctttgcattccccatgtggtaagatcaccggaagcatttacaattcctgattgtactcctcttttctgaagcagcctttttgccatttcagcagcataaccttttcctattcctccaaagccgattctcatacctttttctttaagaaaaacagtctgatcttcaggattaagaagaatattctcataattcaccagttttaaatgatccttgataagatttggatccggaagctgcttcatattacggtcaaaattccagaaacttttatctattcctccataggaaatatcaaaatatccgtcagtaatccggctaatgcgaagacttctttcaatcagatcaaaaacttcccggtctacctttacaggttgtattcctgcgtaatgattgatcaggctggtctggctgttttcactgaaagtagtgagcagtttttcaattctctgaatttcggtcactgcagcttctatatgctgataagccgtattttcatgattatctactaccgttatttcaaaagcgtttcccatcagcttctgaggctttctgaattctctgagcatctgttcttattttctttgctgttggatatcttttatttctttactaaaagccagtgcgctctcagaaggcaggccttcccagcttttcagaacttttccgtcctgatccagcaaaagagtataaggaaacagtcctttcgaattgtatatatcggcaagtgctgcattttcctttttcatttctacggaaagctggttctttttgtttcttggaaagtcagcgttaacatagacaataacattttctgtctccagctttttgaaatcttctgtctctataatattcttatgaagcttgatacagggaatgcaccagtcagatccggagaaattaagtaaaataagttcatttttggctgcagcttcttttttggcattttcaaagcggttctgtgccgtgatgccaatagaaaacatccccatgatcagggataaaaatagtgttttcattattttaaaatggataatgattaatataatacgtttgaacgctgtatatcagcttatgatatacagtatatattggctgacagtggctgacagccttttttgtttaaaatatcaggaaaataaatactttggtggttcccaggcggttctaagaaagcctctgtagcagaaattatcatttcttgatggcattttccgggattttatttgtttaaaatgatcgttctttatttcaaactgaaaagtatctccaataataaaaatcaatgccaggggtgtgctgtgaataacaaagggtaatttctgatctttaccataatcaccatctttaacgggatgatcatagtgtgttttcagaaatgcagtgagagacatctccggattcaactttttgtgttcccaataatgttctatcaaagtcggaatttttaacagttgatacacttcggttgtagaaaccaaatagagtgacagcaacaatatggaaatcaactttttcactctatcaaaattataaaatatttcattaagaatgattttaaataaaatttcttttagtctgtttttaatcaaatttttcaaagaaaaaaggtaataaaataccggttcaactccggaaacagttcttcgaaataaactagtataattgaaaatgaaagataaaaaccagtttttaatttcttatgccagcagccaaaaaaagtattaattattactcatttaatagtatattgtaaaacaaatctgcattattatatgtctgccaaacgttacgttcaaacccgagccaggaaaatcagaaaattctttggattattaggtcctggattaacgaccggtgctgctgatgatgatccttccggaattgcgacatactctcagacaggggctcaattcggttatgggcagctatggaccgcactctatatgctcccgtttatgatcgcagtgcaggaagcctgtgcaagaataggactggttaccggtaaggggctgacgggagtaattaaagatcattacagtaaaaaaatactatatggttcagtaggattggttgtgattgctaatactattaatatcggagcggatatcggagcaatggccgctgcagcacaattaattattcctgctgatattgtcatactgatgcttgtttttaccataagcatattaacattggagatattcaccagttacagggtatattcaaaagttctgaagtggctggcattatcccttctggcctatcctcttactgtattcattattgatcagccctggaaagaaatactgaaggcctctattgttccccacttcgaattgtctttcaactttcttttcatcataaccggagtgttcggaacaactattactccttatatgttcttctggcaggcctctcaggaagtggaagaagaaaataaaaaaggattgattcaagatggaaaacccaaaatcggatggtatcatattcatgcgatgagaaaagataataatataggcatggtcatctctgaatttactacatggtgtatcatcctggttggaggaaccgttttgcacaacgctaatataacagatattaatactgcagctgatgcagcaaaggcattagaacctttggttcagtcattcccagattccggattgatatcaaaaatcatctttgctatcggtattatcggcttaggactgcttgctgttccggtgctttcaggatcggcatcttatgctgtttcagaagctctcaactggaatgccagcttagacctgaaattcagaaaggcaaaaggcttttatatggttattatcatttctacccttattggtctttgtatgaattttatcggcattaatccggtgaaagcccttgtatataccgcggttctcaatggtgtagcagccgtaccgctgttgtttctgattatccgcatatcggcaagcgaacgcattatgggagagtttaaaagcagatggctttccaaaagcttattgtgggccacttttttctttatggccaccgcttctgtggcaatgctgtttaccatttaaataacaattccctgttccacctgtgctaagattatttcttcatcttttttaggaatgttaacaggtatctgaagctctgtctgaatttttaccctgagtgcttccaatgcagaaggttccccgtgaacaagcatgatctgcttgggaggaatttcatattttttaacccaatctattaattcagactggtctgcatgggcagatagtcctgtaatttctgcaatatgggctcttacatcatagtattttccatgcattttgagttcatgagactggttgagcaaagccctgcctcttgtaccttcagcctgaaatccaacaatcaggactgtatttctacggtctccgatataatgttttaaatattccagcactcttcctcctgttatcataccgcttcctgcaataacaattttagactgtttttgtgcaattatttcctgggtttcagtataatcttgtgtaatgtaaatcttctcaataatatcattccacttctgtctgtcgactaacgtatagtctgagtatctgaccataatttcggtagcggaagctgccattggactatccagaatcaccgggacgccggccggtattttattactgtctttcagttcctgaagcatataaatgatttcctgagcgcgtcccacagcaaaacagggtataataatatttccgcctgcttttatggtcagattaatccaatgttccagctgatcagacaaatctttgtgatcatgaagcctgtcgccataggtagattccatcaccagaaaatcagactgtgtaaaaaaaatcaggaggggccagaacagcactgtggtttcgtccgatatctcctgagaaaactattgtttttccaaagcaggtaatttttacagaacaggctccaataatatgcccgcagggcttaaacatacagcttatatgatcgcccagcttaatttccttattttcatcaatcacaaaaaactgtttaaaagatctttctgcatcatttaccgtatacagaggttttgccggatggtgccttgtataatgatgccggttggctttttctgcatcttcttcctgaagcttggcactgtcaagtaatatcagttttgtcagttccttagtaggaccggtcatgtaaattttgcctttaaacccattttttacaataagtggaatatatccgcaatggtcaagatgggcatgggtaagaataatggcatctatttcagaaacatcggtattcaggggcagccagttttgctctctaaggtattttatcccctgaaataaaccacaatcaattaaaatagtaagttcaggagtttttaataaatgctttgatccggtaactgtttctgcaccaccaagtgacttgaaagtaatcgtttccattttaatacaatttattggacttttatttttttattcatcttctttactgtatttgccttacccatctttatgtaaagccgtccgtttttgtaccgtgctttaatatcacttacatcaattccttccggaagcctgaaactccttgcaagggaagacgttaaaaattcttttctgacataattttttttaatttcttctttttcatctgttgcgtaagcctgaatgttcaaaacaccattttctactcttatcctaaaatcttcttttttaaagccgggagcattcacctgtatcctataattcccgtttttatcaatgatatttacggaatgttctattttaccaggttggttaagaatttcgtttttactccagaattcttctgttaatagttttaccggagtttgttttggggctgaagttttcataataaccatttttggattagatatcaaaggtaccctaagacgtatttggaaaccatgacaatgatcgtatttaattgtgatcgtcatcatctttctgccatgtgttgatgacgctgataacttcataagcatcggaaggattagtgtttctgatatgtgtccattgtaacctgtcatgctttatttcaggcagattacctgtgaaaggatctttaagccatgtgattatatatctgacgcctaatgaaacaaattttttaagaatagaacacgaaacagagcctccatcaccagtaatgataacaacatcttttgaacgggcaaaatacactgttatttcatctaacggaacattgatgatggtaattttatgtcttttatgattggctaaagcaaggaattgtttatcaatctggcttatctggtatacgatcactttcatagcttctgttcatacatcaaatgtattgaagatgaaaaaagctaaccgtgtgcaaaatcattattaaagatgatctgtattttaatttttcattttctgtaatcgggtaatgtccaaaattgtaattctgccggcatttctgtcaataagcccctcttctttaaagtctccgagtatcctgctcactgtttctatagccatgccggccatagaagcaaggttctctctggaaatttcgaaatttcctgtcccggaatgagccttgtatagcttactcaggacttctgccattctttttctgactgaaaaataagcaagctgcaaaagctgttcttcatggctgataacattttgtgccagaattttaataaatttttctgccacatcaggatatttgcagaccaactgatccatcacctccctcggaatggaacataaggcagcatcttcaagcacttcggcggtttctttatattctcttcctgtaaacaatgaggtgattccgaaatattcgtcaggataatatacatgtgtcatcaactctttcccttcctcagtcatttttgtggtttttactgatccggaaaggatcaggtatacagcactcgccgtatcaccttcattatagataacctgcttctttttgagtgttttgattttacggtcatcaaaagattttttcagttcttccaggccatttacagattgaaacagatgattcatctggtcatacttactgctgtaaaactttttctgatgttcttttttcctgagcctgctctcaattgcatttaaaagttcgatatcatcaaatggttttgtcagataatcatctgctcccatttctattcccttacggacttctgccctgtctgcttttgctgtaataaaaataaaaggaatcaatgaagtttcttctctcttacttaacagatagagcactccatatccatcgagttcaggcatcataatatcgcacaatataatatcaggtatgtgtctgatggccagttccacgccttgtttaccgtttttcgcctgcaaaacctcatagtcagccagctccagaatttctgaagtgctttcccggatgtcatcatgatcctcaatgattagtatttttgtttttgtcatgaataataaacttttattttcgcttaaaagacaatgtaaactgagttcctttaccaggtgcgctgttaaaatctatatgcccgttcatcaggttaacatatcggagaacaatatttaatcccagcccggttcccggaatattaccaatattatgagccctgaaaaaaggctgaaaaagccctgaatgatcttcttcaggaattcctattccattgtcttttactgtcatcagataatattctttatttatttccgtacaaaactcaatgagcgtattttccccggaatatttgatggcattactgatgaggttcataagacagttccttaataaattctgatccagaaataccctgttttctattccggtatgctgataaattatgatttgattgtctttggtaatcagctgcatttcttccacaagctcttcagagaatcgtataatgtcaaactcatgataatccggcgttacaatacctgcttcaagcttctccaaagaaagaaagtcgttaagaattccgttaagacccgtgattgcattttttattttatgaaggtgtttcaggatctgggaatgatcagcaagctgaaggtatttttctataagaactacggaaagctgcatggagcttaaaggggtacggaattcatgcgaagccatggatacaaaacgacttttcatccggttaagttccttttctttttcaagggaaatgttcgcttcttcttttgccttttccaatgcacttagcatctcctgaagagattttgttctcttttcaaccaggtcttccagctcaatggtatactttttaagaaactcttcggcttctttttctttcgaaagatcatgaataaatccggtatagatcaccctgtcattaagctgaacttcacttaccgcaagcctgaatggaaattgggaaccatcttttctaagtcccttcacttctctgcctttaccaattatttttttctctcctgtattctgatatcgaagcagataactgtcatgcccgctatgatcaggttccggcattaacatagaaatatttttaccgattaactcttcttctgtgtatccgaaaatctttaatgcagaagggtttaagttttcaatcctgcctcggctgtcaatggtaataataccgtcaatagctgtttctatgattgcatgtaagagtctggaactttccataaaaaataaatacttacccttattaaagataagtattttaaatcaactttctacgaaatactgtaatatgttagtaaaatagcattttttaaaagggtgtttcatcaatattttttaactctaaaaataaatatgacctccttcaggaataatcaataaagggatctgtaaatcctgagcctgtcttgctgcgtggctgcctgcaatgagcctgcctataaaacctttctgctgatgccccataacaagcatatctatatctttctcttttaaaatattcaatcctgtatcaatattctcgctttcgatatagttgtagcagattttcccctcaaggtctttaaagaaagcatctttcttctgttgataggatgtattttctataagatcaacagcagtgtctgtgatatgggtaataagcagttcagcattgaaatacttcgcaaatttgatcaatgcatgtgatattttgatatccatcttattcagatctgtagcaaaagcaatctttttcagttgtttatattgatatcctgatggtatgagaagtagtgggtattcagtatgctcaatcattttgatactgttgcttcccagaagaaatcgtgcaaggttgcttgctcccttcattcccattactaccagtaatgttctgtttccggctgctgtatcattgatcagccggatggtatctcctgtttcgcaggtgtaatagatggaaggatgaaaaggaaaggaatcatccccccacaattgtttttctttatattctatatttttaacttctttcttcatttcatcctcgtattctttctttaatacgggatattcatacaaagcccatgcggtctgcccgagcataggttcttctataggaatcctgaaggcatggcagagctctatattgctttttaatgtatgtgccaaatgcagggcatattcagctgcagttctggctggctctgaaaaatcagtgggtactacaattgttctcattattttagttattaaaattgaatttattctccaaaacaggatcaagattataaatatcattataaaacaccacctttccgttttttacaaggcaggtaaggtatgtaatcatgatgggaaccggctgttttaaaacaaaatcttttctttcgtatcgatccataaaagatttcatcagcgggatctcatcttcagttccatcatgtttaagcagctgcgccgccagatctccggcattttctacacggatgcacccatggcttaaggctctctgagttttttcaaataactgtttctgagaagtatcatgaaggtataccccataggaatttgaaaacctgaaaacgacagctccaagcgcattatcacagccggaagactgtcttatactatattgataaggatttctgtagacctgtttcaaatttgctgatgtaacaggtactatcttccctgacctgtcatacaacgaataatgatgttcctcaagatactggctgttctttactattttaggaagcatctctttgatgaagatattctgaggaaccttccagtcaggagcggttgtaaaataatcaaccctactctttaaaacaggacttggcgtagagggctttccaacaatcaccttataatggagtgtcttgtctttctgaacaaaatccagagaataagcaggaatattcaccaacagataagcatcactgcttatgcccatccagcgcaggcgctccatattaatagctacctttttgatttctgcttcccgattttcagtaccattgctgtagattgtattcagataatcctgaaattcaacatactcctggattttaggctgcacatcaaaagcaacttttggcaaatcatctttctgtagtgcctgatacaatatctcaccggctttaaaaccttctacatcattaccatcaataaaagacggactgtaaaaaggattgtactttccaaagtgtaagtaattgatataagtgataagtgcatctgtcattacaatatcagttacagcattttctttagaatctgtatatttagtttggtctgcaacagtatttaaaatttccggagtaaggctctgctcatggtaatctttggaagacaatccccttttacgggtatctttcagtaaaagaactgcatcctgaagcagactgtgcttaacagagggattgatccaagcatattcaaacccatgttgattgtaaaactgttttactgattttggaaaatgcagttccggaagatcatctttactattcagtacaaatgctatttgactggcagcatttacatcttgtccgtgaagcattgcaacactgaaaacaattacgatccaattcaataaagttttcataatcctgaatttattgatgtaaagttccaatttcatcacatcataaataatgacccttatcacataaaaaaatgatataatcctgtagtatagttttcttaacaatctgtttcttgatcaatcagcttaaaaatcataaacacaactatcatatgatcaacatcatttttcaaaatgacagtcatcattcctttaacaggaagtctttctgaactttgaactataaaattaactacagatgaaaacaaacgagcaattgcagaaagatgttcaggaagccatcaaatgggaaccgctgctccaccctgcagaaataggagttacagcagcagatggagttgtatccttaagtggtacggttgatagttttgcgaaaaaaaaacaggctgaaaatgcagccagaaatgtcgccggagtaaaagtactggttgaaaacatccaggtaaaacttccggattcaaaggcaaaaactgatattgaaattggcgcagaaatcatcagtgcactcacttccaatgttattattcctcaagataaaataaaggttaaagtagaaaacggatgggtagatctggacggcgaacttccatgggattaccagagggaaattaccgaaaatgcaatacagtttcttcccggaataaagggtatttttaataatatcacaatcaaccctgacaccaatgatactgtcagcaaaaaaaaagttgaggaagcattgaaaagaagtgctgttgacgagagagaaataacggtctctgtaaatgataccactgtaacgctgacaggaactgtccattcatggcagcaaaaggaagaagcaggccggattgcctggaaaacgcctggcatcaaacatttaaaaaacaaactggaagttgattatgaatacaatttatagttaaacgattccggttagcagaaactaaacagaatattgtggaatcttttcttaaaaaaagctttactcttgctggcaatatcgcctcattttctgcccggtttttcagggagattctgaaatccggttttgaatataaagagtttaccagacaatgttttgttgtgggataccagtcattacccctggtaacggtaacagcttttattatgggactggtacttaccattcagtcacgtccagcaatgtccagatttggagccgaatcctggataccgggcatggtttctctttcattaataagagaaattgctccggttataaccgctttaatctgtgctggcagagtttcatccggaattggtgccgaacttggatccatgaaggttaccgaacagattgatgcaatggaggtttccgctattaatccttaccgttatcttgtggtgacaagaactctcgcaacaacattaatgatacctgttctggtaatttttgctgatctggtcggcattctgggaggttttataggaatcaatattcacggagacaatagtatcagtcactatttttcccatgtttttgaatctctggaatatgccgaccttcttccggcaaccctgaaaacattttttttcggcttttttataggaattattggctgttatcatggttttaatgctgaaggaggaacaaagagtgtaggaaaagctgccaacacagccgtagtttcagcttctctgatgatttttattattgatctgctcgccgtacagattgcggacttattttttgaactgtaatgaaaacatatgaaaactttaacgctgaatttactttgcccctgattaatcaaccgcttatcgaatttaaggatgtatataaatcttatggcaataataaggtgttatgtggaatcagctttcaggttggaaaaggagaaaatctggtaatattaggaagatcaggttcaggaaagtctgttacggtaaaatgtctcgtaggtcttaccaaaattgatgaaggtgatatttatattgccggaaaagcaataaccaaccttaatgaagaagaactcaacaaggtcagaaaaaagatcggttttctgtttcaaagtggtgccttatatgattctatgacggtgagacaaaatttagcattcacgttacagcatcataataaaaatctaagcgaaaaagaaatagatgaagccattacagaagcgctaagcaatgtgggccttgaagaagccattgataaaatgccatccgaactttcaggaggaatgcgcaaaagaataggcctcgccagagctctgatcataaaacctgaaattatgatctatgacgaacctaccggaggactggatactattacagccaaagaaattatagagttgatctgcagcattaagcagaagtttaatacgacctctattattataacccatgatttattatgtgcaaagtataccagtgaccggattattgtattgaaagatggaaaagtgaatactgaaggaacttatcaatctattgaaaacagtacagacggttggataaagtcattttttcaaaaataaacagaagaataagtcatgaagaatgaatcatcaaacaatctgaaattagggatctttgttacggcaggaattatcctgtttatagtgaccatttatttcattggtcttaacagaaatatgttcgggtccaattttattttacgttcagagtttgaaaatgtaagcggattaaaacaaggaagtaatgtacggctttccggaatcaatatcggaactgtcagcaggatagactttatttctgattcattggttatggtaaaaatgagtatcaaaaaagatgttcagcaatatattaaaacagatgcagttgccagtatagcctcagacgggttggtaggtgacaaagtccttgttatctctccgggaactggttcttcaacagtagtaagtaataatgctgtaattgcttcatacaaaactacagaaatagaagatgtgcttttcagtatcaagaaaagtgcagacaatatccagactgtctctactgaactggttgatttcacagcaaaaatgaataataaagatggtttattggtaaaaataatgaccaataaagatttcgcaaaccgtatagacaaaacaatacagaatcttcagacaagcatgaatgatatcgctgcattcactcctgttcttcacaataaaaatggtgtaatttataagatatttaccgataaagatctgagtgagaatattggaagcagtattcttgatttaaaaaacagctcaaagcagattagtctttttgctgcgaaactgaatgataagaacaatatactttcccaaatatcctcaaacgacactttagctatttcattggaaaaaacgctgggtaacctggaaaaatcttctgaagaccttaaaaaatttacctcaaaaatcaataatgaggaaaatgtggtttccaaattagttgataatccaggattaggcaggtctgtagactctaccatcaataatatcggtaagggagttgatgagcttagagaattagaggctgcagcaaaaaacaactttttattgagaggttattttaataaaaagaagaaaaacaataaaaattaattatcttagttttcaactatgcgattaaataatatttctacattctccttcataaaaagtcctgttccttcagccattgcagtggcagacccacacgcaattcccatggacaaaacttctttataatccccaccttttacgaggacggaaagcataccggcaaccatactatctcctgcacccaccgtacttttcacattcacagcaggtgcattcatttgaattttttcggttgctgagaataaaacggcttctttctctcccaatgatacgaccacaatctgagcattgccatttgagattataagccgggcagcctgatctatatcttcatcctgcagcctttcttttccgaccaaagaagctaattctcccagattaggttttaataggaaaacgccttcttccacagccatttttaatggttctccagaagtatcaatgattattttacttccgtttgctttacaaatgcggacaatttttttcataaaatccgtatttgtatctggtggaagacttccgctgatcactacaaaatccggagaagaactcattgtattgatgctattcaaaacactctcctgttcttccattgttaacttctctccgggaaagccaaagcgatactgattattattggatgtatccagaacaacgaaattttctcttgtttccccggtaacatataaaggctgtgtattcagattttcctgtgtaagcaaatcttccagtaattttccggttcgtcccccggaagtaaaaaaagtttccgatactattcccaatctttttaatgctctggaaacattgattccgccacctcccgcttcatatttaggagaatggcagcgtaattttttttcaggaattatgttttcaacgctgctacttttgtcaactgacgggtttaaggtaattgttaaaacagattttttcattattcctattgtaaaattaattgtttgatgctattctcaatctctcctattcttttctggtctactgtatcattagctataattataattcctaatttgtcatcaggatataaagtacataaagtgttgaatccgatttttgtattgccatcatggtagatatacttttgctattatcagtattcagcatccagctagtttggtcctataaaattaatgaaaagatgaactattgatatcaacaacttctattatttaatcatttaattctttaaattttatagttttccaattgaaccgaaataagcctatttcattaagttcattgggaataaaaagatctggatctttttaatttgctaaataagagctgatgaatattaattttttacgacctttaaatgaccaaattgggaatattatgataaataaattgttacagacgattgaaaaagcagtcgatgtagatcaggatgaaaaagaactcattgccaggcttttccatgaaaaaaaatatgctaagggagaatattttctgaaggaaggtgatgtatgtcgaaatgttggatttatcataaacggtgtcatgcgatattatattaacgatgatggagaagagaagacttacggctttgccgaagaatccgatttcgtttgcaacaatgaaagttttctgccccagcagccatccaggcaaattatccaggcgttggaagactgtactttactagttatcggatatgatgatcttcaaaaattttatacttccatcaaaagcggtgagcgtttcgggcggcttgttattgaacaggtttttattaagactttacagggactgaattctttctatacagattcacctgagcttcgctatgaaaaatttgtaaaagaatatcctgagttgcttcaacgcattccgcaatattatattgcttcctatgtcggagttaaaccacagtcgctgagccgcatccgaagtagaaatatccgcagaaaatgatttgttaacccaggtgcatgaaagttgaaaaggatgcagataactttgttgtcaacttaaaaaacaaatagtatgacaacaagaatttgttacatcatttcatttttgaccgggataggattgttatttataggtctgagatttttgatttcaccggttaaagccgaattcgattttggtattttcaccaatacccataaagattattccttccactatatcaaagggaccagagatatcttttctggtattctgcttctacttctggtattggcaaagcaaaaaaaggctctgggaatagcacttctctcagcaactgtggtgcccttgggagatttcatgattgtaatgggcaaaaatggaagcgattggcagcatgcgatagctcatttgatcgctatagcaatctgtattattacgggcccggcactgttatggcaaaaatctaaaaagagcagttccggcgaacaaatgtccttcaatttaattcattcagcagctgatggcggacctacagtaacagagtgtgatctgctccctggtgcaaaaactccctggcattaccatactttattttcggaaaagtttgaaattctgaaaggcgaactggaagttggaaaagctggtaaacgttatcaactcaagcccggtgatgagattgttatattggccaacgaaacacatctttttcataacagatccgggagcgtatgtcgcatacggacaaccatagacccgggaaatattccatttgagcaggcttcattaattctattgggtctcgcgaaggatggttttaccaatagcagcggaataccaaaaaggttttcagacttagctttgtttctttatttgaataattccaggatgacaggagtaatgaaaattgcagaaccatttttaagacttgttgcaaaaatcgctatacataaaggccgattgaaggttcttgaagatacttattgtaaaacagccggattatattgaatactccagactatgcctgacaggaaaataaaaaaaggaaaaattaccccaaaaatttaatattaattctatcagagcaaaaacgcgctgtcccgggctgaatatatgtttagacatgaccctgttttttttgaacagaccaatatcattaaccttaataatcaataagttgtttttctcgaatatattcactatcttgtaagtatgaaaaaaaataaaggtcaggatagtataacacacgctggcaaaattaacgaacggacaaaagctttggaagttcttgaacaggctaaaaaagtacaaggaaaaataacatttctccgtcagggagtcgggaggaattttaaaccgaaaaatgaagaataaaacaatattcctgaaagaatgttttgaaaacagcagcaattgctgtaaacaaaaaccctgcaaaataattatttgcagggttttttatatttttgagggtatgctgtattgaatgattaaagatctcagaacagtttcagcctttcatattcagtctttcctcctgcaaatccaatagccgtaagtgtttcctgatgatattttcatccagtaacagttcttcacggtttttagcgataagccagtttctttgggtgtcgagaatatcaatataaatacgtctgtattcctcatagtttagaataatttcggaactgttcagcagattttcatatttctgtaactgatctttcaacgccggaaagctatctattttatcagcatagtcacttttgattttatcaatcgctactttagccagactgttctggatatcgtaatctatctctttcacgcttcttacgaaatcccggtctaccggaggaaattttctcagtaaaaatggaagggtaagtccttgtaaaagcagcgttagcaaaatcacgataaatgtaataaacagaatcatatttctttgcgggaacggagacccatcatctaaagtcaagggaatagaaagcgctgctgccagggaaactactccccgcattccggtccatcctataataagaggagttttccagcctggtgactgaggatcggcaactgtgataaaatttctcataattaaagtcgtcaccaacgcaccgtagcctgctaaaatcctgacaataatcaatactacggtgactgcaattccgtaaccaatggctgtataaatatctgtatcacctaagccagaaacaatttccggcagatccaaaccgataagtataaacactactccattcaagagaaagcaaagactttcccaaactgttaccgtacgtattcgggatgcactgcttaaaaaatcatgactgcgataagaaagaaatagtccgcctgttaccactgccaggactccggaagcatgagcttgttctgctgccaggtacatagaaaacggtgcaataaaggtcagcagaatatctatatttgaatcggttggcaacattttatgcagtttcagaaagatatacgcaataacaagtccgattcctaccccaccgaaacacatccagataaaacttcctgctgcttcatgccacacaaactgcccggtggcagcagcaatcatcgcaaaccggaaaataatcaaagaagaagcatcattcagcaaactttcaccctccaatatggaggccagccttttcggaacttttacaaatttcagaatggctcccgcactcacagcatccggcggcgaaacaatacctcccagcaaaaagccaagagccagagaaaatccgggaataaaataattggcaaatacagctaccgagagcgcagtaaagaaaacgactacgaaagcaaagctgaagataatccggcgccaacgccaaagctctttccatgaggttgaccatgccgcttcatacagtaaaggaggcaaaaaaattacaaataataattcgggttctacttttatgggtggcacacctggaataaaacttattagaagtcctgctaataccaacagaataggatatgcaactttaattttattggccagcatgatgagcatggtaattaagaaaaccaggaagagataaaattcaaagtctttaagcatgtgcaaattttagatatttaaatatattaaattctcaaaaactttattctttttataggaaatttacatcattataaaattgttaatttttctatactcataattcagtagtattaatacttctttctctggcagccactaaaataaaagaatcgtttccatattaaaagccccttttacaattgttgtaaaaacggctttattttcagcttcttcccgggtgaggaattgaaaagttctcttttatatttgttggtaaggtctacggctggccttttccccctgctgctccatagatctgccctgtcacaaaactggcatcatctgctgctaactgaacaaatatagaagccagctctacaggctgtcccggccttccgagaggtgtatcaccaccaaatttcaccagattttcctgagtctgccctccgcttacctgaagaggagtccagacaggcccgggagccacgccgttaacccttatacctttcggtcccagctgcttggcaagagatttcacatagttggttgttgctgccttggtttgcgcataatcataaagatcagcggacggatcataggcttgaatagacgatagcccgataatagaagaacccggtttcatatggggtaaagcagcctttattatccaaaaaggtgcataaatattcgttttcatggtccagtcaaaatcttcagaactaagatccagtatagattcattggctttctgatgtcctgcattattgataagaatatccagccctcccagttgctgtactgcctgactgaccaattttttacagaagtcctcactacgaatatccccaggaatggcaaaccctttacgcccttcctttctgatgagctctaccacctgcttggcatcatcctcttctgcaggcaggtaattaatggctacatctgctccttctcttgcataagcaatggctgcagccctgccaataccggaatcaccgcccgtgatcaatgcttttcttccctccaatcttcctgagcccacatagctcttttctccgtggtccggcaccggtgtcattttacctgccaatccgggaaaaggttgcgactgtttattaaaaggcggtttgggatatttgtttcgagggtcagtgagctctttagcattcgtttttcttgtgttgctactctgtgactgtgccaaagcacctggggcaaccgcagcaacggcaacggttgcggctatttttccaatagcgtctcttcttgttattttactttccatatcaatataaattatttggtgtttaagaattctgtaatgataaaagatcagtacgatccacgatatttaaagcccattgtcttccggatactgaccggcaactgttagggactaaagctaaactgctatctcacttaccaatgatgaataaagatgtaattgatctgacgtaataattataagtgaagtaacgtctgtaaatgtaatggattgaataacaaaagttttatgagacaaatcataaatttatctgcgtttgacaaatatggtgcaaacaatagaacaagtacatcattaaacggtaaaaaaaatataccataacaaaatttctcgctaccttaaaccgtttaactaaatatctgaagattatatatttattagtatgaaaaatcataagttaacagcacttttaattatcataacaatactattttcctgcaaaaatgaaaagaaatcggacattcatccggtttctgataattcaggttttgataacagcaatattgattctactaaaaatccctgtactgattttgatggctttgccaatggaaactggaagaagaaaaacctgcttcctgctactgaaagcagatggggtgccttcgaaattcttgaccgcgacaacaaagtgaaactgaaaaatattgtagacagcataagtaaactgcctgacctcaaaccaggttcagaatctcagcagatagctgatttttacagatcttacatggatactgctactatagaaaagttaggactttcaccacttcaaagctattttgagcgaattgaccatcttaaagattataccgattggataaatttctccggggaacttcaaaagcttggcgtacccactttcatcagttataaggtagaagccgatgctcataataatcagatgaatattctttcgttagggcaaggcggactcactttgggtgataaaagctattatactctaaaagaatctaaaaatgccaacctaaaaaacacaatgatccggcacatcgacaatatgtataaaatggcaggtattaaagagctctcccccggttctaaaatttaccaattggagcaagacgtggccggtttgcagctatccagtctgatgttgcgagatcaggtaaaaacctataataagatgtctgtcccggaacttaaccgcattgcaccacagcttaattggaacgtttttttaaaagcgcagggaattaatacacagactgttattattgaagaccgggcttatatgagcaatttaacagctcttctgcataaaacaccattagctgtattgaaattgtatacccggtggcagcttttatctcattttgcaccttacctgccgcagaaatacagcaaccctcacttcgctttcttcggaacggtaatggctgggaaaaaggaacaaaaaagccgtatagatacagcaattaaagagttagagcaagcactgggcatgcctctgggtaagctttttgttcaaagatattttcttgaacaggataaacaaaagattggtgaaatgattgaaaatgtgcgccgggtttatcatcaacgtatagacagcttacgctggatgagtaacagcaccaaagcttccgcacataaaaaactaagcacaatgactttcaagatcggatatccggacaaatggcccgactattacgggatctccatacaaccatctcgtttgatagacaatgttatttctgtagcagttttccatcataatgaaaatatcaggaaaattgataagccggtagataaaggcgaatggcacgcaacaccgcaaaccgttgatgccttttacgatcaatataccaacagtgcttgtttccctgctggtatcctgcagccacctttttataaccacaaagcagatgatgctataaattatggtgccatcatcgcagcgataggacatgaaataacccatgcttttgatgacagaggttcgaaattcgatgcgtcgggaaatttaaataactggtggacatcaatagacagacataattttgaaaacctcaccaaacaatacattgattattttaaccaaatggagggtcagccagggttacatattaatggagagctcacaataagtgaaaatatagcagatcttggaggacttacactggcttaccatgcacttgaaaaaagttacgataaaaagaagcagccttcccccattaacggtttcacctggcagcaacgtttctttttaggatgggctcaaatgtggcatggcaacatcagtcctgaagctttacgtaatgaactgctgaccaaccctcatgtacctttcagatttaggataaacggcccactggcacaaatgagggaatttaaacaagcatggaattgtgataaaaaaggttcagctaatttgaatggcaaaggaatagaaatttggtaacctccttattccggctgtataattacaaaccgaacgaatttaaattcatttttaatatctgttcgtatacgttgtatagcttcggtgatctcttcagtatcaaggtgttcttccaaatcgatgatcagcatcaatattacctcttccggcgactggtaagtggataatatattttttacttttacgacagcagcatccttttctgcaagtctggtaattttgtctcttgtctcagaagcgattccttctcccataagtaaacttctgctctcccttgctaaaataaaggaaacaaaaaccagtaacaatcctacaattactgacgccaatccatccagttcaggaatttgcatggaatggctgaaccacatcagtatcattactataataagcccggcaaccgcagctccgtcctcgaaaacaacaagaaagctggatggatctttacttttgacaattgcatcccaccatcccatcccattacgggtttggttaaatgcttttattgcaataataaaagaagttccctcaaaaataagtgaaagaaacagcacgatatagttccagaaaggatctttcattatttcaggttccattatgtgtgctactccctgatagattgataatgccccacccaggccaaatattaaaatagaaactacaaaagaccaaaaataaagttccttgccatatccgaacggatgcgattgatctggtgcttttttactcctttttatcccataaagtataagcagttggttagcggtatcaactgttgaatgaattccctcagagatcatggaagaactgtttgtaaagcttccggcaataaactttgtcagcgcaattaacagatttgcagcaagagcactataaatggacttctgattattgttcataaattacttttatagatatgaaaagattttttctaaagcctgctttcgtagtattagcaattgattttcgtattaattgccattggacttgctgcatttgttgttttcatttcacaacaaaatccggcattcttaaaacttaaatttgatctgtattttagttttcctatttgatcatgttacaaaaaccaagccgccggaaataaatgaattgaggatctgacccaacatgaagtgtcggtatttattttgtttacaattccgaaaaccttgcacaaactctaggttttgaacatacagaatgatattttgagctttcagcaaatcatttggatcaatcttcacaacgtcaaaacgctcatcaagaactctgaaaacttcctgttgcaaaaaacatcggattagataattctattaaatcacaatcagatatgtagtagaatatttaatgattatacagcctgagaatctccaccaattcaggtatagaccgtattttaagtttctcaaacaacctgtttttgtatgtactgatcgttgatgaatgaagattcagcagattagaaatttctttaagcggaagaccttctgcaagcttattggcaatttgcaattcgcggtcagatagcgcttcaaggggagaattttttgctgcaccagttaatgattctaaaaaaatcgcatcttttatattatcactgacatatcgccctttattgagcatcgacgttaaagcagtctcaatgacttcagtggagcttagcttgcttaaatagccgccagcgcccattttgagataacgcatcccatataactcttcatcctgtgaagaaaatattaaaatttttaatcccggttggtgaacctttatgtaatctattgcttcctgaacagtaccattaggcatattaacatccataatggccagatccggtttttcattcagaattaatttgtacaacgatttatagtcctctacttctgaaatgatggcagcgggcattaatcgtttgattgtttgtattaaacccatccggacgataccatgatcatctgctactacaatacgaatgtctgcttttaaacccattattctaaaaatttatgtaaaaaaagggaaaccgtagtacctttatcttcatcggaaatgatttggatgtttccatgcagcaaggatataaaattttttacaattttcaaacttaatcccactcctttctcgcctgcagttcccagaaatacagggttaccatacgtgtagatcataggtaagtacttttcatttattcctgttccagaatcaattacagaaagcacaacctgatcaccctccgtaattacctgtaaacaaagctcctgcccaggaaaagaatattttaccgcattgttaaaaatcttgtccagaacatattcaagcaacagtcggtcacttgtgaggaaggcattgtggtctcctttaaaataaaattgaatgtttttttcttttaatttaacagcgtatttttcttctaaatagtgaaaaagatccatcaccataatggtaacgggtttaatcttaaattccccgtattgcgttttcagccatgcaacgctgtcctggatagtttgcagattcttgtgggcatctttttttatctgcggcaacagcttaaaaaaatcttcctcacttatggtcttctgctctagttcttctataagccacagaaaagttccaaacagttcttttgagtcatgagacaatatcgaaatcagtccgttcttgaaattgatctcattttccagtctttcaatttttaattgtagttcattgataaaatcattcataaaatccgtttcaaaggttttagaagctgtttgaaattatttttttttgaaaaaagtcagaaagggttatattgtttaaatgtgaataaaaacatatcgttcagacctttcttccgggaactgccaagttataaaaaatatcatattagtaaaaagaaaaatcaaatagaatttacctgaaataacaattctcctacttttttcaactaaaaatgaatttgtacggcataatattccaacaggctttcacgctgaaaaacggtcacttgcattacgaaaaatggctaaaaggtgaaacagggacaatatcaacagaatattgatcgtaaaaatccgaatgatacagaataaaaaataacaagctaaaacagcaatacctgatagacaaactacccaaaacacctctacagatattgccaatatagaggttgatagaacaaaaatcatcaaaggaagaaacgtttgtatatagaaatacgtcaggaatcctctggaaagttctgtagcttcagccaattgctatgacggaatcacagctataaaaagaaagtaaaagctatttcagaaggcatcgttaaattgtcgtaaagctataatacacattgacagagtaagtggtattctccttccctaccaaactttgggcgcccgccggtggtatggtgtatcttatgttcagtccccggtccagaaccggtgctccgttaaaaagtattttttgaggagttttggataagggcacctttacagaacctccatccactccaatttgtaaaatgttcgaattgatatcggtctgcaggccgcctttcttaaaataattttcgtccgattttacatagagctcaaaattttcattgttggaaagcataatctggttgggaatcatttgtgattgtccatcggtatattgggctgcggtattaaaattgaagttgacagtgcgtccggaacttggaatggtaatctccgacagaggaagcaccttcaactgcacagctgtattctgcaaactgttaatagagttatctgtacttcctgcattgaagttcaattcaaaagtataagttccggcttcaaaaaaaaagtttttaaaatcttctgcagatacataaagctgcggaatgaagctgtttctgtttcctgctgtaacactgaaattagcagcagaaaaattctgaaaatcggcagataaagctttggttgtgaatgcagatccattactacccagtttaatacttgctatatttctggtccctggaacacctttagaggaagtgaactgaatgtttgcggaagcagctttggctaaaaaattaaaatcaaccgtattcgcaatttctgtattccccaaatcccacaccttcatgtttgcattgcggtagtcattcaaagaagatatctctatgtattttgttaaagagcttgtaatccatcgtatggatgaaggaatcactaaaattgttttaaaattacgaggagtgaaatcattataattctgagtaatatccatagagtaattcccggcccggaaggcattggcagtaaattgtgcagcaggaattttaaatgtaaaattgatatttccgcggttgaatcctcccccgatactgatggatggcggttcaaaccattttatagcgcttgtactgaatgattgaaaacctggcaaatacccggaaagtccggtagatggcagctgcccgcccatactttccaactgccacaaaagagtggatccgggtaaagtagatgaggaagaagaatgagtaaaagttgatccggaaacagaggtaaatgtaggagctgtgggcagtaatcccaaaaaggcataatcccagtttgttctgttggcattcgtcattacccttgtaggtactgaggtaaattcgctcctgttaaaaatattattttcaggaacagacaggtacacatcctgagctttcatgaatgcagacccgcagaacacggtaaaaattcctattagaaaaaacctcttctttttcatacttttaaatttaaaactttttcaccttaatggtggtgtctttcttcttatattcaaaaaccacgctttttgagtaaccttcttttgtcacctgaatagtttggctcggctgtgtatagctgtatttatcattttcaatatagaggttatactttccggctttcagaaaaaattcaaactcattcttctggttaaccacggcggtatagattgtgccatcttcactttttgcatatactactattcctgttacatccgtctccaaaacatcataagcttgtttgatctctgttaattttccgcttaccctgatgtttttcaccaagcctactttgcggttaatattgttatggaccataatgacaggatccatcatcaaccgggcacccgcactttcattcaccttcagagtgtaattaccttcaggcacattctgaaaaaccactttcccattcttatccgtcatcgctacataattgtccagttttataatttcgttagcaagtaccggttcaccggactccagaagtccatcagaatttttatcttcaaagaactggaacgtcactttatgatttccgaaagctgtagccggggtaaaatattttttaattcccactctgaactggtaataactgccactgattgaatattcagctgtagatttatagccagaaagattaaaataacctgttgtggaccaggaaggtgaaaccttatactccagattaccggtgatattactgttcaaatttttataaagttccgaatagaaggttcccgctgaaaaagatcctgtaagattatgattaaacatctggaaattataagaagcgtatacattgtaattagcgaaattacggcttacatcataataagaatttaaatcaaagacactggttgcattccattgggctgttccgttgagagagaatgacttatatctgtaagataaagtagttttcagactgttgaaccagtccgggttattattctctttagaataagaatattccgctgtcaggttgaatccatgggcacctaaagtagtgctgatattggcttccaacctgtaagagaaaagttcctgtgaggtataaaaattagctgttttttgtttctcaacttttggagacagtagaaaattccatttctttaaagaaaactgataccctagtcccaaagcttctgtactgtttaaataatagcgcaaatcagcagtattcccagattggacaggggcaccctgatagctcaggaattcaggatttacctgcgaattctggtattgtataaaagcccgctgagaggcagaaaactgacgaccaatacgctgatttgagaaaaacgatccccgtttgatccctgcataacttttggtggcaaaggaattaacagattgtagatcccattttcctattttcccttcgtaattggctcccattgaagccccggcgttttcatcatgattcaaaagtcctttttcgtgacttacacccaactccgtgcggattgcgtttttatcgttaattaacaatgatgtaactgcgttcgctatctgtgtatctacattaaaccgcggatcatgttcaaatatataggatactttcccgttgaaagattttacattgccaaaagaatattttgcacccgccatggtagatccttctgtttgctggaaatatgtaccatacagattataattattttccagcgcaagaatttcaacctgattattatttccgaatctggcagaaattttcccacctcttccgaaaaccgggtaatcgtaatcgctgctattaacatttcccacccgtaatactgtattttttctctccagctccagccatgtgtcatataagttataaagaccatcttcatgatagtaatctgcaccaatattgaagcgtgatttcaggttatcagttacccggaacgctgtatttcctctcaattgaagataattgaaacctgagctgttttcattatagctcatttcagcaaaattacttccgctcaccgcttcgtttccacgggcaatttgtctgttatgtgataaaacgaccaggtaaagcgtgttgctacccacgattttattatccagcaggtctgtgacgatcgcattaatattaaattccggataaagtgtattctgttttctgaccgcaattttgatttccaacgtttgtttttctaaaccttccagagatacagtctgttgttttggcattacttccaaaccatccggaatggattgcaaatcaatcttaacggtacgtttactgtaaccctggttttctacggtaagcagaattgaggactgtggtaaagcggggtcaatgaaattttcgtatgtcgctgtataaattgcgatgtttttgttgtctcctttagcaacgaagaacgaggcgttttcagttctggttacggttggggtaacgtaagaaacctggaattggatcttattggatttcagtttcataaaatccacgttggcaatcagttttaccggaagagttttagactgacccgcacctaaggttaattcatttttgggatagaaaagcaatcccggatagttttcctgaggtatgatattctgaatggtaatctcttcagaacttttattctcaacgaccaggaaattagtaaacgtagaacctttttcaacagttacgctgtcattttcaaaatggatgctgatattcttattttcctgcgcaaaggccaacgaaaagtgcagaagaacaaatacaaaaaataagattgttcttcttagcactgatatcgatattccattctgtggtttcaaggcttaattttaaaatttaaagtttttttctcctacacgtaaatcattggattctgccattttaacaatagccacacccaggaagtttcctgaaatattctctggtaaagaaaattgaacaacctgattggtatccggaaacatagagattgaaattgcgggtaattttatttccttaccactgtctgtgttggtaagttcaaactcaacagtggcatcattaatcgtatttccatcattatggatgcttactgcgacttttctgttcgctgcattctgattactcacctctgcaatattggtaatatccagacttttcacatggttccccggtggagtgtaaaagatatgaagtcccacttcaaataaggtgataataccaattccattctgaacacgtgccttatctgcctgctgaggaagctgggtgaaaaacagcatgctgtttgtaacggcagatggtgatgcatttgcaggaatctgcatggttactgcaatctcctttatactttttgcaggaacagttacagtattttctaaagtggatacccaggaagcattggaagtttttgaactgcctgcctcaagataaaccttatttccgtcttcttctctataccagtctttatagttgagattaaaaacataatccttatctgagctgttttgaagcgtgactgtctttgttactttttctcccggattacctgtaaaaaacaagcgtgtaggcgacatagagatgctttgtgccagaagtgaagaagatcctgtgagaataaagaaaatgaaaaggtgaataaacttgtgcatggtgtaaatagtttaataataaagattcccaaaactactgaaaacattgcaaaaggaacctttacaaactaaaaattttattataaagccgtcgcggtataagttactgtctgcgtatacgttccggccggttttcctaaaatatcagatgatgatgatttcgccgctggaatagtatagtctaaattcagtgttaatgcacttcctagcggagcattggataccaaagtctgatctgttgcagatagcactacagcagtttttgttccccccatacttccggcagcagtagaaggtttgattgttaaaacattcacaggaatcaggttcgttccattcataaaattagcacctcctgcttttacctttacattaaagttctttgtagaagtaacttttaaagagttggctttagtaactgtttggtcagaattataatctgctgcagtaacgtagttaaagtcaactgtattacctattgcagtacttcctgcatcgatagagattacatcattcagggtgatgtttaccgttgtggttgcagtggtattttgagcttgaacattattagttccaaatataattgctccaaaagttaaggctgtgattacgatttgttttttcatgatggtaatattttattgttatttttatttaattgttctcttttgtatactgcaaatttatagtggcgataaaagtttctttgtagtggaaaaaggaagttcatgtagtaaaatcactacaggattgctcattggctttacatagaaaaaaccctcagcacttccaggtactgagggcagatatattgatgtgttttttttattataaagcagtggcagtataagttactgtttgtgtatacgttccggccggctttcctaaaatatcagaggatgatgatctcgctgctggaatagtgtagtctaaattgagtgttaaggcacttccaagaggagcattggctaccaaggttctttctcctggggataaaaccacttcgtttttggttccgcccatacttccaggagcttctgcagctttgattgtcaaaacatctacagggattgagtttgaaccattgatgaaattcggaccacctgcttttactttcacattaaagttctttgtggaagtaacttttaaagagttggctttagtaaccgtttgatcagaattatagtctgcggctgtaacatagttaaaggcaactgtaccaccaattgcagtacttcctgcgtcgatagatattacatcattcagggtaatatttacgtttgtggttgcggttgtattttgggctttaacattattggttcctactatgattgctccaatagttaaggctgagattgcgatttgttttatcatgatagtactatttaattgttattctatttaatgttctcttttgaacattacaaatctacagctactacaaagccgtcgcggtataagttactgtttgtgtatacgttccggctggcttacctaaaatatcagatgatgatgatttcgctgctggaatagtatagtctaaattcaatgttaatgcacttcctagcggagcattcgatactaaagtctgatctgttgcagataacactacagcggtctttgttccacccatacttccggcagcagtagaaggtttgattgttaaaacattcacaggaatcaggttggttccattcatgaaattagcacctcctgcttttacctttacattaaagttctttgtagaagtaacttttaaagagttggctttagtaactgtttggtcagaattataatctgctgcagtaacatagttaaagtcaactgtattacctattgctgtacttcctgcgtcaatagagattacatcgttcagggtaatgtttaccgttgtggttgcagtggtattttgagcttgaacattattagttccaaatataattgctccaaaagttaaggctgagattaagatttgctttgtcatggctgtaatatttaattgttatttttattttatttaattgttccttttgaacactacaaatctacagcggtgataaaagtttctttgtagtggaaaaaggaagttcatgtagtaaaatcactacaggattgctcattggctttacatagaaaaaccctcagtactttggaagtactgagggcttatataaattcctgttataatatagattctacatcacagctgacagatacctattcccggattttgaatttctctataacgatatcaatacataaaaatcaaaggcctcccgtagaaagccttcgaaacaccaaatcacaaaatattaatatgaaaaatttatttataaagctgttgcagtataagttactgtctgcgtatacgttccggctggcttacctaaaatatcagatgatgatgattttgctgctggaatagtgtaatctaaattcaatgttaatgcacttcctagcggagcattggataccaaagtctgatctgttgcagataatactacagcagtttttgttcctcccatacttccggcagccgtagaaggtttgattgttaaaacattcacaggaatcaggttggttccattcataaaattagcacctcctgcttttacctttacattaaagttctttgtagaagtaacttttaaagagttggctttagtaactgtttggtcagaattataatctgctgcagtaacgtagttaaagtcaactgtattacctattgcagtacttcctgcatcaatagagattacatcattcagggtgatgtttaccgttgtggttgcagtggtattttgagcttgaacattattagttccaaatataattgctccaatagttaaggctgtgattacgatttgttttttcatgatggtaatattttattgttatttttatttaattgttcttttgtatactgcaaatttatagtagcgctaaaagtttctttgtagtggaaaaaggaagttcatgtagtaaaatcactacaggattgctcattggctttacatagaaaaaccctcagtacctgaaagtactgagagcttatataaattcctgttataatatagattctacatcacagctgacagatacgtattcccggattttgaatttctctataacgatatcaatacataaaaatcaaaggcctcccgtaggaagccttcgaaacaccaaatcacaaaatattaatatgaaaatttatttataaagctgttgcagtataagttactgtctgcgtataagttccggctggcttacctaaaatatcagatgatgatgatttcgctgctggaatagtatagtctaaattcagtgttaaggcacttcctagcggagcattagatactaaagtctgatctgttgcagataatactacagcagtttttgttcctcccatacttcctgcagcggtagaaggtttgattgttaaaacattcacaggaatcaggttggttccattcatgaaattagcacctcctgcttttacctttacattaaagttctttgtagaagtaacttttaaagaattggctttagtaactgtttggtcagaattatagtctgctgcagtaacatagttaaaatcaactgtattacctattgcagtacttcctgcgtcaatagagattacatcgttcagggtaatgtttaccgttgtggttgcagtgatattttgagcttgaacattattagttccaaatataattgctccaaaagttaaggctgagattaagatttgctttgtcatggctgtaatatttaattgttatttttattttatttaattgttccttttgaacactacaaatctacagcggtgataaaagtttctttgtagtggaaaaaggaagttcatgtagtaaaatcactacacggttggttcatctgatttaaaaagaaaagccctcagtactgtggaagtactgagggcttatatacaattgcttttcgttttattataaagcagtcgcggtatacgttattttttgagtgtaagttccctgcggttttccaagaagtaccttggatgctttttccgccgaaatagaataggcaatatttaaagactgtttggagcctaaacttgcattactcaccagcacctggtccattgtagataaagtgacctcattcagagttcctataagacttcctcctggtaatgcttttacctgcaatacatctacaggaattaaatttgctccacttacgaagtgtgcaccttcagattttactttaacatcaaaatttttggaggaaataatgactaaactattgggaacggttatatttttagaagaattataatcttttgtgctcccatagttaaaatctacagcaccttctgaagcaacagagccaatatccattgcaataacatccgataaaataatattgaccgttgtactcaactgctccgaattttgtgccttaacccatttggttcccagggcgattgctcccagagacagggcagcgataaagatttggtttttcatgattaataaattttaaaaaggtgtaataaaatattgtcactcaggaactcattataaagctaataacattatctgacattagcaagacttttttcatcattgcgtgtattatcatcataaagtttaaagttaattaaccagattgccattatcaggatgtttaagggaattgttaatgcccggaaactttacttaaaaatctattttggctatggatctggtactgtagtaaatgcaaaatagaaatattatgtactcatttgctgattttgaagaattatgagatttctttatctttgaaaagaatataattacaaggatcaaatattatttcctgccagataagtaacaaaagactgtgacgaaaacatggtggttgttcttcaagatggaaatatggataatatacattaacttaataagtcctgcaatttttagaatattgcaggatttttttgtctttcaattgcagattgttcaaataaatttgtaagaattttgattaattgtgataatatttttaactaaaattacaatacatgcagctttatacagaaagattacttctgagagatattactattgatgataaacatgacattttcgattaccgttcggatgcagaagccaataaatttcaaagctggattcctgaaaccctggaagatgtggaaagttttatccaaagaaacagtacagagttcaatcagcccgaaagctggtaccaactgttaattacggataaagaaacaaaaacagttatcggagatatcggaattcatttcttcggacatgaaaatgtacagacggaattaggaattactttaaatacggctttccaaggcaaaggctacgcctccgaagctttaaaaggtattatcgatttcctttttaatgatttgcataagcacagaattactgcttctgtagatcctggtaatacagtttctattcatttactggaaagaatcgggctgagaaaagaggggcattttgtgaaaagtctcttttggaaaaacaattgggtggatgatgttatttatgctgttctacgtgaagagtggcccgcaaaatagatagcatatttcgatctcaagagcgacttttttagtaaccggcattaaaaaaacaaaaataaaacctcctgaatgatcaggaggtgaaaaagtgtaaaatgaattataagttatgtgaagtggtgtccgttaaagcttttctcaacacatcaacgagcatgccaaattactcacttgatattgaataatatatttttgtggtacttttttacgaaaaaccttacagataaaaatcaatgagtgcaaacaggcaattactagagtactgtatatctttcgtaaaacggagtgatttttgtctttacaatcactaaagtaaccatatcattgcatatcatatatgatacaaccattgttctgcaccacttcttagtgataacagtaatccagccatccttttcttcccattggtacatttcttttttaaaatgcataataacataatccctattcttaccgtttaacgaaaataagtcttgcataatctctgataatttattttaacaagcttttatgacagcgcgttccatggattagttttattattccaaatatagtgaaatagttgaaattatactatacagttgtttgattttaataattttaacagtaattttagaatattcctgtaaattataaagagatgaaattacggatcactatctttaatgaaaaatcacctctctttccgattactttagaagacgcacgatttattgaggaggtacccggctgaaacagatttcaaatcagagttttattcatcatgcttccctgaattttaaaggaattgtaccacaaaaatatctaaaagcaaattcaatcgtattaaatctatattaactttatcccaaaaataaggctaactttaatagtgagtatcaactttagccctcataactttctgccattctatataaccggagatggccactatgaataaaaatgaggttaaaacagcatatagatataattctttatgcagtaacagagggatagaaattatattgctgatattgaggattacccagttctcaatttttcttcttgccataagccacatgccagcccatgcaaaagcgcttaccagagaatcccagacaggaacatccgagtcggtaaaatgagtgagaaaagaccagaacaaaatgaatgttcccagaacaattcctcccgcaatccatttttctgtcgtggaagtaactgagatttccatttcagatttctgctttccgaatttccagtaaagccatccatagatgctcatgatcagataatagaggtttaatataaattcagcataaagcctggaagtcagcatcacatatagtgtaagcagaatgcctgcaattccgaaaagataattattagaattgtttttacgggccagtaagacctgaattaccgaaaataaaaccccgaaccattcaggccaggtaatttgatttaaaatgtcctgcatcatgttaattttggaaatcaaatgatgagatgatcagtaagcaatccctacgccggcattatccggatcaggtgtggaatatatcctgggtatcatctcagccaccgttaatttgtagcaccccattgttgaagcaaagttgctgttttttttcggaaaaagaaaatacatcatactttattttagaattatatgaccaggattataaagaatccgtcaggcaaattataattttatgcttagtctaaaaaaaatatattatgaaaaatcaggaagaaatcgcagtattaaatgacctacttcacattaccaacgacagaagggaaggctttgaaaaagttgaaggaaaagtatgggaaatgtatcccgatgtaaaagatgagtatgaccatatgatttcacaatcgaaaattatgaaaaatgaactgattaacctcatcacagaaaaacatggtgttcctgatgactccacttctatggccggagctcttcacagaacatggattgatattaaaagttcatttaccatgggaaacctggtagagtctacactggaaaacgttgtttttggagaaaaagcagctatagaaacttatgaaaatgccctgattagcgggaacctcagtgaaaaaagtaataaaatagtatccgaacagcttcgcagcctgaaaaattcgtataaccagttcaggaaaattgaagaatataaaaagaaagagtaaatccataaaaaaacccctcttaaaaaagaggagcttattaatcaagaacaaaataatatttaatcctttcaaaaatatcaaatatatggtgctctttttatgatgcaggtcataagatctgcaaatcattatttcactgcattttttgctttttcagattcgtgcaaatgatgttctaatgtaggaagggtcttgccggcaaacgctttaagagaagcgtcttttccttctgaggattctttccggaatgcttcaatatcttctttgtgatcactcaccataagatctgtatactttttgtcaaagtcttttccttttttggctttcagatcatcatacatcttctgcttttcggcatccaaggctgcaggcaaggtatagccagctcctgaagcccatttcttaagttcgtcatttgctttgctatgatctgtaaccatcattgcacccagggatttcacaactgaattctctgcattggttgcggccagttttcccatcatcacttccataagtcctcctatggctgcggcatctgcaaattttttgtcctgatcattcagagtaccggtgtcgttctttgtttcaggcattttagtggagtcagttacggtcgtacctgattctgcaggagcagacattgatgtactttcatgcgattgggtacttgatgtcgattcgttttttttgcaggccatcaaagcagcagctgcaaaaattgttactacaaaatttttcataataataaattttaaatggtgttatcaataaagtctgtaatgacttatttatacaagcaacaatttatctgccaaaaaaagaacaaaccttaccataaaactttatgaatgaatattttaagactgattaaccaatcgaaatgtcagattaatacgctctttcatagcagttacagatttagcaatacggtgctcccaatgctcctgcaaatctcctttcataatcaataatgaaccatgaggaagcgggagactgtatttactctgatgatggtctttttttctgaaatcaaaatttctggtctgtcccaagctcaccgatgcaatcacgggacgtttgccatatctgctttctttgtccctgtgccaggcaacagaatcattatgatccctgtacaagttgagcaatacggaattgaactgatacccgaatgtctcttctattttttgtttcaaagaaaacagctcaggtgtccagtaacaggtttccagttcaccgttccccgaaggatagactgtctcatcatctccataccatgcggttaaccgcggcgttaagacagtcttatcgtacattttctgggttctttgtttccaggaaaccgtttcaagcagatgagccctaagctggtcagcttcttccctgctcaggaaatgctctctgtactccagaagatctttcggaaattcgtacagatcttctgtattaaataaactaagctgctccattgttgttactattttcagtcaaaacatataatcctttccacatatcgatacaaaatatatctgcaaatatattaaacatgatacataaatgaacattattcttttcacaaaaatctgaacaatttgttttcagcatttgttactatgtgattcacatcataaatatttctctttttgatcattaagtttgatataaccaaattgattattatgaaaaaagcagcattatatatgttattattgctcatgctgtcagcatgtacaaaatccgaaactcaatataccgatcaaaataacagaaaagaaacggtaaatgacaaggcttcagatacgatccaaacccttaccgagctttcagacaccttgcagcaggaaaacgacagtataaaagtaagaaccggcaatgaataaggatcattatcctgtgaatccaaaaggcaggctcatcattattggagacagcactccctatacttgtctggaagtggaacaggcaccggatattaatcaaattccttctcagttgttcaaattattatcagaacataagaacatccgtattgaaattatcatttcagattccatgcctggatatacagaaaagtattctgctgtattacagaaatatggatatataaacttagggattattcatgttcatcaggaaagtaattttaatgattattatgccagaatctcgcagtccggaatagtttttatcgcgaatgagaatccggaaatttgtgaaatgctgaaaaaatctgaaatactaaagcttttacataagaagtacattcatgaagaagattttacaattatcggaatgaatgccgcttcaatgtatattcctaaaattttggtgaacgaaaaaggaattcatcaaggtttcggatttatcaataactgtatcattgatacaaaatttgagtgcggaacaagatttaaaaagctgatcagagccattatgcttcatcctgaatgtcttggcattggccttaataacggtatgttgatggttattgagaaaggctacaaagcttcctgctacggcagcagtacagtaatggcagtcgatgccaggcatattaagaaaagcaaagcaggaaaaggaactactgtttttataaaaaatctcaggggacatattcttaccgaaggatcaggtattaatgtatgtaccggagatcttattaaagataatcagtttcataacagtttaaattttacccgtagaaatacaattcaatgattttaaccttaaataaatttacatatgatacccaaaggaaaattacttattatcggcggtaaggaagacagagacggcgatgaacctgatatggaagaaaaaaacaataatttttcacccaacgagattcttaaactgctggtaacctctaaagatgaccgtattgaagtaattacaacagcaacttccgaacctgaagaaatgcaggaaacttacaccagaacatttgaagaaatcggatataccaactttggctttctggatatttgtgacgatcaggtacatacagatttttacctgaaaagaatagaagaagcaaaaacgatattctttacaggcggtgaccaggataagatctgcagatttttgcagccctctgtttttacggatattttgaagaaaaaatataatgaagaagaaggctttatgattgcgggcaccagcgcaggagcaatgtgtatgcctaaaatagttattctcgaagcagtaaacggagaagcaatcctcgaacatgacattgagctggattccggattgggattcattgaaaactgtattatagatacccattttgcacaccgtgcaaggttcggaaggcttgcacatgctgtgattttacatcaggaatgctggggaatcggccttggagaagatactgcgcttcttattgaggaaggacataaagctacctgcagaggatcgggttctgtatggatcatcaatgctaaggaaatcagacagacaaatactgaaactgctaaaaaaggatttcccgtttatgtagaaaatctaaaggttcatattctaacagacaactgtaaaattgatcttatgaataatatatttgaaggagcaggcacaggagaccaataagacgaaaaaggagacccgaataaaaaccaggtctccttttttataaagattgtatgtttacattgctttgctgttaagattggtatcagcaacttttgtaagcagttcatcacattttttttcttcttccaatgtgcttaaaaagtttttaagacactcttcttccttcaatacttttgcgaatgctgccagtgtaccatacgtagcaatttcataatgttcaactttttgtgcagctgcaatgattcctgcatctcttactgcacctggttctgtctcttccatgatgcttttcccttcatccagcaatccctgcatggcatcacacttttttgcctgggcttttttacccaatgctttaaaacattcctccaatctttccacatgaccttctgtttcggtgatatgcttgtcaatgccttttttaagtttttcatcggtagcattcttcatcattaccggcagcgctttcaacagtgctttttcagcccagtaaatgtctttcagtgcatcttcaaaaagatcttccaggctcttggctgcattttttttagccggcgttttggctgttgttgtttttttggctggtgcttttttggttgccgttttagtttccataatataatattttagtgtttgattggtgataaatctgcaactataagaccatttttgcctgaaatacgaagatgtggtatctaaaacttccggagatactattgcaatatataataagaacagctgtatgcagagaataagaagcctgcaaatccgtaaaccattacggtgtttgcttttttacccatacacttaccgaaccggaatttacccggaatacagcttttccgttctgatcagcagcaatttcttcgtggcggttcttcaagaaatcaatatagactgaatctgcatgttcttttcccaattctatttctttatagccttcttcactgttggacatgatcacaacacagcccggatgcttttcatctcctgtccgaacaaaagctatgcagttgggatgatcaaaataatcaatctgattaccgtatgcaaaaagctttcttgcttcaaggagtccgggaagttcttctaccttcggcatgatgatatgtacttcctgatcttcttttatatcaatatattctgcaccaaaaaggtcaggataaaatacacagggataagcctcatcagtaaggagaataatagcataagccaaaggcttgaaccaatctttcaccgcagactcaagagcctgaagctgctgcgtatcatgattttccacaaaggaaaccgagaagacgggtttcttttccagaaaacttccttttaatattccactcagatcataatttttaccttcgtctgaggctctgaagaaattataatgcagcggcgcatcaaaacaggaaatgagaccagtcatctgatcagaaaaatattcaattttctcggcttcgtctttccagaattctcccagaatataacattcagggttaatttctgtctttatgtattgagtccagtctttcaggaagtctgaagaaatgtgttttaaagcatccaggcgtatcccgtcaacctttgtggtttccatataccatctgatccagtttttcatttcctgcacaacataaggattacggtattctatatcagctcccatcaaataatcataattaccgaactggtggcttacggcatccgtccactcctcaccatattcattgtggattttaaaaacacccttcagctcctctccttctctgatcacataatcaataccactgaaacagtgataatcccatataaagtccgaatacactccttttcttcccggaaaagtaaatttcgtataggccgaaacctccatattttctgagattctttcattacggttttcttcattcagctgatgcaccaccagcttttcttcttcatctcctcctatcctatggtttaaaacaatatctgcgtacacagacattcccgcgtcatgcgctttctctatagccattaaatattcagctttcgtcccgtaacgagtgggtatacttcctttctgatcaaactctccaagatcataaagatcatatacatcatagccacgcccttccatattgagactgcatttattggctggaggaaaccagacggcagtaaaccccagttcttttaaatattctgctttttcagtaaactcattccaaaggtttcccggatggtaccaatggaaaaactgaatcataaccccgttcatatattatgattaaccgttaacaatcaagccgccattcgggtgaagaacctgcccggtaaactgtgcggaggcctctgtagcaagaaataaaaagcttgctgccacttcttcagtagaggcattacgttctaacggcggtttatcctgatcctcatcctcttcgccgaatgttttttccgtaagcggtgtggctacaggcccgggtgctacggcattcacgcgtattcctttcggtttagcctgaagtgcgagtgagcgagtgaacgaaacaatggctcctttagtggctgagtaatccagtagttcttcatgtcccatataagcagtggcagaggttgtattaataataactccacctttttttaaatagggaaatacaaattttgtcagcaggatcattcctataatgtttgaatcaaaagtctttctgatatcttcttctttaaggtcctctatcgcattgcacggaatctgtgtaccggcattattaatgaggatatctattccaccgaatttggaaacgacctcatcaacaacagttttacagaatgtactgtcattaatgtctccttcaaatgagagaactttgtgtcccagtttttcaatttcctgacttgttttctgagcatctttggcgtcatggtagtgtataaatgcaatatcagctccttctttggcaaataaaagagcgatggctttaccgattccgctgtctgctcctgtaataaggacagatttatttttcagttgtaaatctttcataagtgtgattatagtatattattgaaataggtttattctttgttttcatgacgtttatcgagttccagcttaaagcatcccagaatgaattcactgtaataaagctgagcattaacagactttgttctggaatgcagatctaatttttcagaaagaacaacctttcctttataagcaatggcgaagtaagcgaaaagctttccatgtgattcttccaccggagtagcatatcccgttactccgatagaccaatctgttttgtatattttacctgcctgtaatgccatgatctcagcaatatgaggagatacactgttatattgcatggcttcagcagcatctacatcaagaagatttactttttcttctaaagtatacgcggtcattccccctttaaagaattgagaagcatctttcatctgggaaaacgaaaactgcaggaagccagcagtaacactttcggctgttgaaacagtttcatgccccgaaagcagatattctcctatacgcttaaacagcttttccagttctataacgaaatgcactaaggatttcactgataatgaatcagcgtgagcaatttgtgaagattttaaaatcattgattatattttatatatcaggacttcccaactattcctctttcgcagaatccctggaatcttgttgttctttggactgcttgctaagcttctcataatatttgtggagtttgtccagctcttcttccgtgagatcttcaatatcaaccaaccggttgctggctttttcataggatgcaatcagttcattaagctttatctgaatcgccttggaatctttgttctgagttttttgaatcagaaataccatcagaaaagttacaattgtggtacctgtattgataacaagctgccaggtttcagaataattgaaaagaggtccacttacagcccagacaataaccagtaaacttgctgtaataaaagcacctggacttccggttatacaaacaacacgatccgaaaacctttcaaaaaaattttttttcataaataatacgatttgaataaaatgatgatacaagttatcgaaacaacagtataataattatgattcaagtcatctacggcttttattacttagctattattataatatattttccaacaatatttggttttatttaaaaatgtgaagaatcgcataattatttttatccgttaaaaacaagcggtttttgtcatcatttcctgtcttaacaaattgtaaacgaaagaggtaaaacaattaacatattcaaaaaagtgagcaatacagcatgattcaaaaactgaataaaatcacttcgttaagatttaatacttaattaaaaaataattattcatctttgcagccttaaaatcaaacacgctagtttatttcatgagcattatttttaaaaagcgtctaattatagcgcttgtattacctacggcggccttgtattacgggcagagtacgaaggattcattagaaaaatccaaatctattgatgaggtgatgttggtgggtagaaacctttcccaaacagccaaagagagaaaaactcctgttgcagtttccaacatcaaggcagcagaaattcaggagaaactgggaaacagagaattccctgagattatgaagtctactccatccgtttacgtcactaaagtaggtggaggattcggagacagcagaatcaacatgagaggttttgatggtgccaacattgcggtgattatcaacggacagccggtgaatgacatgcagggaggtactgtgtattggtctaactggacgggattggcagatattgccagcaatattcagatccagagaggtttgggagcttctaaatttgtagttccgtctgtaggaggaacgatcaatattgtaacaaaagctaccgatgccgagcaaaaagcaatgatcaaaggtgaagttggaaatgacaactactccagaatttctgcgatgtattcttcaggattaaaaaacaaatggggaacaaccgtattgctttcccgctggcaaggtgacggatacatcaacggaacgaaaggagaaggttactcatggtttttctcaacaggatttaagcctaatgaaaaacatgctttcaatttaatcgcaaccggggcaccacaggtacacgacacaagaagatcttctgccaccggagcaaacgtagcaacactgcagcagtttgaaacctatggaagaagatacaacccgcaaacagggatgttaaacggttctcaattcaacctagctcctaacttctaccataagcctatcgcatctttgaactgggactggacaatgaatgataatcttaagttatctacagttgtttatggttcttggggacgtggcggtggaggtaccggacttaacggttctatcaagaacgccagcggacaaaccatgaatttcatgaattatggtcctggcggagatggtacgatcaactgggatatgatttaccgttacaacagaggtggtatggtaactgattataatggaaataccttccagaagtctacctttactgcacctgcaggttctcccggtgattacaacggacaatatgtttctactctgaacggaaccagcggtatcgtaagaaagcagagtatcaatgctcatgactggtatggagtgattgctgaccttaattacaaaaaaaataactggactttcaacggaggtattgatcttaagacctataaaggcgcactgtacgatattgtaacagatatgttaggatctgatgcgttatttgttccttccaccgccaatgctccgaaaggatattacattaatcaaactgtaaagccggagccgcttaccaagcttaaagatgctcagaaagtatctatccacaacgaaggtctggtaaaatgggcaggtatttacggaatggttgaatacagctctgaaaagctgagtgcatctgttcagggatccgtttccgagcaatattataagagaagagattatatgctgtatactcctggaaaccaggaaacaaaatggtaccacaaaacgggttatattgtaaaaggaggtgccaactataatattgacgatcaccacaatgtatttttcaatacaggggttatctcaagacagccgttattcaacgcgttattcccttcaaaccagaacatctacaatgatgcgaagaatgaaagaatcttttctgtagaattaggttacggtttcaaatcccgttatgtggatgtgaacatcaacgcttacagaacgcaatgggatgacagattcatttcaagaacattcaatgctactgctgcagatgttgccaaattctctcagttaacccttggaaatgcttacttctataatgcattgaacgtaggacaattacaccagggaatcgaattggaagcaaaagcaagacctttcactaatcttagattaagaggaatggtatcattggggaactggaagtataaaggaaacgccaacttcaacattcttgatgttcagaacaaccaggaaattgcaggagcaaccggaacgatcaatatcaaagacctgaaggttggggacgcagctcaaacaacagccagcatcggagctgattataatattaccaaagctttcagtattgatgccaactgggaatattatgacaagctttatgcacagttcaacccgatcaatttccttacggaagccgcaagagaaaaaggaattgtaaagttaccaagctatcatttatttgatgtaggagcttcttacaaattcaccttggatgcgaaaaaatctttaacattgagagcgaacgtatataacttattcaacaaatattatatttctgaattaagctccaacatcttcgcaggcgataaaattgccaatggcccggatgccggaaaaacgtatcaggaagctggcagagtgtatcagggtattgcagacggtaatacaggattccttggttttggaagaacctggtctgttgcagcaactttgagattctaatacaatatcatttcaacaatgaagtaatatgcaggctgttcctttttggaacagcctgttttatttattaatcagcaataagaaacttaaaagtttttaggctttctgttctgagcagcctgtcttgcaatttcatcaatacgatttttccgggtttcaggtcttttggcaagcacaatccattgcagcatcattttttttatggacttgctcaaactttgaaaataggcttcagagccttcatgaattttaaatgcttcactcagatcttccgggattacaagctcttccacactgtctaaaatattccaggagccattttcttttgccattctgatggtttcaaatccagctttcatcatcagattattttctatcagcttctgaactttctccttattaattttagaccatgtactgccgggcttacgtctgctgaataactgtataaaggatccttcatcaagggtctttcttgtactgtcaatccagccaaaacaaagggcttcatctaccagttcactccaggaaacagagggtaaattggattttttggtattgcaaataagccagacagactgttctatatgatgattttcttccagccattgccgccagtcctcccttgttttgacatgaaaagtttttttctcattcattttcccgtagtttagttttactatgatgtaaagttagaatactttggcgacaatagtttgtcagtagtaaatttctatttcttaattatcacaatccataatgtaagtctattttaaagaaataaatgataaattagcccaaaataaataattaaatatttatcttgttcagtcagatatggatagggaaactatagattatatcattaggtatttcagaaggttaatgacggagaatgaaacattagcattgaatcatcatatgtatacttacaaaagttctgatagtatttatttgaggaatataatgtttgaacgagggtggattaatactgaacctgaaatcataaagctattggagaacggatatgaagcttttgaacaaaatacagtaaaacggatcatgagagaaactcctgaaaaagtttttttcaattattgtccaaattgcaataaattagcccgtactccacaagcaaagcaatgcagatattgcagatatagctggcatcatttgacggttgctcaatttaagcttaataatgcatttcaacttaccggaagaaactttttcttaataggacaaattgcagaaggtaaaataaaagaaggacaaagaatagatttaagaatattgggactcaataaaaagcctaaaattcaatccattgaatttgcccttacacgtaaaggaggaaaagcatgggaagatattgcactgggtatagctgaattaactgcaaaagataaagaatatttaataggtatcacacctgtcagagatccgcttgacataatagtggaataaaaatctacttatttctcattcttcacctgcagcgccctctgataaaaagactgactggcaattttctcttctgcttcatcaatggcagtcagcagattatttttattgtctgcgatatctcccaaaacccgggacatcagttcccaaacgggtttcattttttcaataagctcgttcccttttgaagtgagcttaaacagtctttttctttcgtcctgcttatctttttcccactgtatcaattcaagcttttcaagttctttaagcaaggttatcgttgatggatgtgtatatccgatttcattggctatttctaccacacttgctatttcttttttgtaaatggtaaaaatgaccggaaaccacttcaattcaaaatcgattccgaatgctttatagatcaatgcgccatcctttctcaattgctcgcttaggcggtgcagccttgttgatatggcaagaattcctgcttcgttgattacattcatattcagtcaagatttaaatggtaaaaaacatcatccgcactcattaaaggaaatttcgcaggaagattgcttttttcaatctttacaaactgattcctttcatagaaacgccgtgctgctttcagtaccgttatggttcccaaatatagatcatcaattctgtttttgcgacagaaagaaattaaaacttccagtaattcctgtgcaatattcagttcttttcctctgaattcctttttcacaaacatttttctgattgctcctgccctttcgtcaaacttaaccaaggcaatggaacctaccagttctccgtttacaaaagctccccagaagttacctccggcttccacataaaagctttctatctgtaaaaggtcaggctgatcttctatagtaatcggaatattaaactctttctgctgaatcgttaaaatcaggtcaatagcctgctccgaataagaatttcctatgggctgtatttccaatttcatagtgtttgtattttaaagtataaaactacgtagttaaatacatatttacaaattaattttatgctttaaagaaatttaacacaaaagagcaaacctgaattttatctgatgatatttatgtaattttctgatcaaattaataccacacaaaaacatcactttaaaaatgaaaatagaaaatttaaaggcctttgacggacagcactgcgaaactactgcaaccggtactctacttcggcaaattggaattgaactttctgaaccaatgcttttcgggttgggtgaaggtcttggttttatctattggaatatgaaaacgatggacttacctttcatcggaggacgagtaaaacctgatctgctcacacaaaatttggccaaaaatcttaaccttgaactaacggttaaagaaacctcttcacaacaaaaagcatgggatcaggtaaaagcgcttcttgataacgggcagacagtgggattaaaaatggattgttaccatctggagtatttttcaaatcctttccattttgccggacattatgctgctatttatggttatgatcacgaaaatgcattcctggttgataccagacaacaaggcggtaaagtaacaacttcattaaaaagtctggcaatggcccgtgctgaaaaaggcccgatgtcctctaaaaatatgtattatactatccgaaaaacagagcgaaaattcgatctgaataaagcggtaatcactgcaatcaaaaataatgctgcggagtatctgaacccgcctatcacaaatatttcttataaaggaatcctcaaaacaagtactgaaattgtcaaatggttcaatacaagtaaagatattgaaggagaatttaagcaagcagctttactcatggaaaaagcaggaacaggcggagctttattcagaaatttataccgtgattttttgaaagaaagttatgaactgcttcaacttgatctgttaaaagctggttatgaagccttcaaagaaattgctgaactttggacaaaggtatctcaactgtttgaaaaagtaagccagacaaaagaaatgatctatattcatcaggcttcggatattttaaaaacactttctgaaaaagagaaaaaggctatggaaacattggccatgttgtagggattttatcatttctttccataccataaaaaaaacgtatgccattgctgacatacgtttttatgatattatattgctgaaacggttatttccagcctccgcctaaagcctgataaagctctacagctgctttcattttactgtatcttgcattggaaatgttaagctctgcattcaatgaattcacacttgcattcaacacttcaagatagttagccatcccatagttaaccaattcctgggaatagtcaacagattttttataggcatccagttctttttgcttcaattcaataaatgaatcctgtacagaaaatactctgatggcatcagaaacttcttttcctgcagttaaaactgtttttctgaagttcagataagccgtttcctgattggcaagacttacgtcatagttggtctggatctgtcttttatttaaaatcggctgtgccaatcctgccacaacatttgcaaacaatgaatttacactgaataaatggtcaatatccacagactgcaatccgccgcttcctgtcagttttaaagtagggtaaaactgagctttggcagcattcgtcagttggaaagcattcattaaattaaattctgctctcatcacatccggacggttggccagaagctgagtcggatatccgagtttcagatcgatcggaagtttttgtccttccaatgtagatctttcaattgagtgagagggctctcccatcaaaagactcatggtattttccagcagctggatttgtgtatcaatatcaatcagtaatgatttggcattaaaaacaagcgcttcgctttgctgtacggctacttcagtaagagttccggaagcttttaaagcttttgtggcttcaagatttttctcccttacggcaattgtttctgtgataattcttttctgggcatcaaaagtcagcaactgataatacgcagaagcaatggaagacaccaagctgcttttaacggccttatgagcggcaacagttcctaaataagtcgcaagctgtgctttctcctgtgcttttaatttaccccagatatcagcttcccatccgatacttgccgtaatgtcaaactggtttacataacgtctttctccaatgatctgtccaaactgggtgttgatagactgcgtctgaaatgtatagttgggcccgatagaaagtgtcggctgataggctgctttactctgtttaagataggcttccgcagaattaatactttccaaagcaatcctgatatcaaggttgttctccagtgccttggaaatatgcccctgcaatatcggatcagtgaatatttctttccaggaaatatctgcaatattcgtactgtctgaaggaagcatatctgtacggaaaagcttttcgtccacaacgttcttcggtctttcatattcttttctcgccatacaggatgaaatggctccgagtatgaaaactgaaaaagtgatcccttttatgatgtttaataaactcttcattatttttaattagaagttagagtttagaagttagaagttagtttttaggcttatagctaatctctaacttctaatttcttaaatcttaattttattctgctaaattgatatcttcttttttgataggtttgattttttcctgcaatgtttcaaaaatcacatacagaaccggaattacgaataatcccaaaacagttcctatcaataatccgattgccgcacccgtagcgatagatctgttacctactgctccgattccacttgccagaaccaacggtaataaaccgaaaataaaggcaaatgaggtcatcagaataggtcttacccttgctttcgccgcattgatggctgacatcacaatcgtttctccgtgatgccttctctgaacagcgaactcgacgataagaatcgcattcttagccaatagtcccacaagcatgatcagggcaatctggaagtaaatgttattttccagtcccataatcttctggccgaagtaagctcccattaccccaagaggaagggaaataataacgatcagcggaagaatgtaactttcatactgtgcagaaaggataaagtaaacgaagattaagcttaatccgaaaatcaaaagcgtttgagatccagaatttaattcttctctcgttaacccggtaaattctaccgcgtagttttgattcagggtttcatctgctacctgctgtacagcggcaattgcatctccggaactgtatccgtcagagttcgctcctgttacttttactgaagtaaacaggttataacggcttacagattgtggcccgtatgcttttgtcaatgtcacaaattgtgaaatcggagacatgataccagatcctgttcttacataaagctgattcagattttcaatattctttctgttttcaggaagagcctgaaccatcactctgaactgttttccatatttggtaaagtcagcagtataaatacctccgatgtatccttgcatagtacttagaatatcattcacagaaactcccaattgctttgctaatggaacattaatttccatctgatactgaggatattttgtattgaatgaagtctgtgcaaactgaatttccggtctctgcatcagcttaccgatgaattcattggttttcgcatccaggtcagcatattctcctccggatttatcaagcaataccatttcaaaaccggcactgttaccaaatcccggtacacttggcggctggaagaatactactttggcatcaggaacagatcctacaattccgaataactttttagtgatatcttcagaagtctgtccgtctttttttctttcttcgaatggtttcagtttcacaaaggcaagaccgttgttacttccgtttccggataagaatcctctacctgttgaaatcgttacgttctgtacgcccggaactttcaatgccttcgcctgaagggtttttaaagcattataagttctttccatggaagctccaggaggaagctgtacgtcggtaaagataatccctctgtcttctgtaggtacaaaccctttcttcatgctgctgcttgcccagaataagatacctccggtaacagcaaaaatgattagagtaacccatttatgtcttaacaggaatacaaatcctcttccgtaacgctcagtagttgttttgaaagcaatattaaacttatagaagaacttctgtagcaggtttaggtttttatattctgcatgatgtgcttcgtgaggtttaaggaataatgaacataaaaccggactcagcgttaatgcattaatcgcagaaatgatgatggctataatcagcgtaataccaaactgctggtagaatacccctgtaggtcctgtaatgaacgttaccgggataaatactgctgccattaccaaagtaatcgaaataatagctcctgtaatttcatccatcgcttctaccgtagctttcttagcatcagaaataccgtgctccattttagcatgaaccgcctcgacgacgacaatcgcatcatccaccacaatcccaatggcaagtaccaatgcaaacaaggttaagaggtttaatgaatatccaaacaagttcaggaagaagaatgctcctacaatagataccggaacagcaatagccgggatcagtgtggatctgaagtcctgaaggaaaatatatactacaataaataccagaatgaaggcttcaataagtgtgtgtaccaccttatcaatagaagcttccaggaattcgttggtatcaaagttgaaagtatacttgattccctgcgggaaagttccctcagctgatttcagataggctttgatatttttaataatctcctgtgcattggatcccggagtctgaaagatccccatactgatggaagggttgtttccgttctccccgattcctgtataagactgtcctgccaattctactttagcaacgtctttcagcatcaggttttgtccgtttgcaagagatttgatgatgatattatcgtactgctctttatcgttgaatttacctacatatttgatgatatactcaaaagagcttccgctgttttgtccaatagaacctgccgcggcttctctactctgttcattgatggcattggtaacatcagtaggtgttacgctataagcagccatttttgcaggatccagccagattctcattgagtagtttttacccccgaaaacgttcgcatccccaacaccatttacccttttaaggttcggaataatattgatattcaaaaagttctgaaggtatacatcatccaggtccttattttcagaatagaaggacatatacatcagggcactggtctgctgtttctgggtaaccacccctgaacgcgttacttcagcaggcagcaaaggtgtagctcttgccacacggttctgtacgtttaccgctgcaatatccgggtctattccctgtttgaagaaaacctggatttgcgcagaaccgtcgtttcctgcagtggaagtaatataatccattccttccaccccgttgatctgttcttccaaaggtactacaacacttttcattaccgtctcagcgttggctcccgtatagtttgtggagacacttaccgtaggcggtgcaatatccggatactgtgtaaccggtaacgagatcagccccagcacaccgagaatcacaatcaggattgagattacggtggataaaaccggtctgttaataaagttttttatcattagaatttcggttttattgattgaacaagactatccattttgatgggcttcggcttcactgctgttcccggtttcaaacctccgataccagctgcaataactttttcgcctttattaactcctgatttgatcagcgctaagttgtcgattctgtcaataacattcacaacaacatttctggcagtatctcctttatctattttgtatacgtagacaataccctgctgttcgtaagtagcactttcaggaactacaagaacattatcataatgctgagggaatctgatcgttccgctgttaccattacttaataatttctgagcattggagaacgcaactctgaactgaatagtcccggttgtaggatcaatctgtccggtaatggcttcaatttttcctttttcaggataaagacttccattagccagctgaagttcaaccattggtaagtttttgattttctcaggcatagaggctcccggagatttttcaaggaaatcaaaatattctttttcattcatggcaaagtaagcatagatctcagatgtatcagaaatcgttgtcagaggagtctgatcagacgggcctaccaaacttcccacttttaatggaagctttccgattacccccgaaataggtgcacggatgatggaatattcgatgttggcttctactcctttatagttggcttcagcctgtcttttggctgcattggcctgctgaagctgggcctgagcctgagctaactgagcctgcgcagtctgtaactgtacgttgctgatgatatttttctgaaccagaggttttagtttgtttacttcaacctgagccgcatttacagaagcctgagccgctgcaacactggatgctgctgcaccgattcctgccttggaagccgctgcattttcgttcaggatattggtctccagacggaacagtggctgtcctttcgtaacatattgcccttcatctaccaatacctgggtgatatatccctgtatttttgcacgtacatcattgtttaccctaccctgaatggtagccggaaacgtctgataacccactatattttttgactccactgagataacaggatacggcttggcaccatcctgtttcggagcttcttttttgcacgctgtcagtgaaagcgctgcaatggaaagtataactagcttattattcattttatagtttattaagagattcctgaatattttctatgtttttatttaagagtgctttgtaaacttctattctttcgttgtatccatcgtctttacttgttttaaaattgtttaaatcctctaatagtcttaattcgtcctgcattttctggacaattttctcgaatcgtattttttggtattcatcattgatgaaaaaataccgtttccgctcatctattttgttatggtctacgataagctgagcattgagcagtaatgaaatactggtggaaacagagcttttgcttgcagagagcacttcaacaaattcgtcaaaagtaattcctactttctcataatcgaaaagaaggtaggaatagatttttgatgctaaagggggtaagctgaacacggtgccataaaattttacggcatcctgaaaaattttctcatcaatttctatactttggtgcataatataaaaatttgaacaaaagtagaaattagttcagaaccaaacgaacaaacctgatagagtttataaatacacgctcttttaaaaattcaatgaaagttgatttaactttttacctaaattataatcttctcaaaagctttcctcatgccatctcgtaacagaacttctccacaataagaatatcctctcccttcaaggattttcagcatagcgatattgtcatggttcgtatcaaccttaatactctgaatgccatgggattttgtaaactcttcgatatggtcaaaaagttttttcaccataccctgtcccgcaaatttttcatcaactgccactctgtgaacgactacaaattcaccatcactcagccaggctccttctatggtactataggcaggttcgtcattcagaatcagggctgcatacactgcaatctctccatctacagtcaaaacatgtccgaatcctttggcaatatcactttctaccgttccaatattagggtatccgttctgccattgggtgcttccgtcctgccttcttctttcaatagattgctggatgatttcccaaataatgttcctgtcttcaatttccgcttgtcttagtttaatttctggattcatgttgttgattttgattgattaaaaagtataaagttaaaaagctaaagtctgaactgcttctctttgattatatgaactaaaacctaatttttattaacgcaaagattttatttataaaaacttaagattttaagtgagcaaagattgcgactccgtcgttgaataagcgaatggctacccgctcgcttaatgagaatataatatagagttactaaaactttgcatcaaatttaaaactaaccaatacttctggttctgatataaaataacagttcttcaagtcatcttttaaacatttagtttttcaataaattaaagattattttaattaaaaaaccgaaaactaattaaaattaattttcggttcgaagtagtaaaatttaaaattatgaaattgtttattgattttcactttgttgaaggtaagcatcaataatttcaaatgctttggattcatcttccagatctaccattactttcagcgaagttgctgtgggtgttgtagtaaatgtaagatagttgttttcaaccgtatttgtaatctgtgcgtcatccaatttagatttaaccaactgaatttctgaagggttatcactttcataaactgatactctcgtacttctttccatatttctaaatgtttgagtatctaaatgtacaacgttttttttaaaattacaaattccaggttttaaattttattaatattgctctcaattttatctaaagcaagctggatttcttctttcgtaacattcagatgaggtctgaaacgaagagactgatctccacaaggaaggatgatcaatccatctttgaaaagctcgttcatcaggtggtttctttgttctgccgttggcagatcgatcgcacacatcagtcctcttcctcttgcatttgaaattttttccggatatttttcagcaagaacttttaaactttccaacaggaagtctccaacaactcttgcattctccacaaggttttctttttcgatcacttccataacaagctgaaaacgcagcatgtcaataaaattccctccgaacgttgaattgattctggagctttctctgaaaacattgttcggaacctgatcaaatttctctttgttggcaaggacaccgcaaacctgagcttttttcccgaaagaaataatatccggttttgctgtaaaatgctggaaagcccacatttttcccgtaatggcaatccctgtctgaacttcatcaaaaataagtaagatttcgttgtcatcacagattcttcttaatcccagtaagaattcgtctctgaaatggttgtcacctccttctgcctgaataggctctatgataatacaagccactttatccgggtgcatcaggatagcctcttcaatctgaagcaaagcaaggttttcgtttttgatggtttcttcaaggttctcttctgtaatcgggaattttaatttcgggtttaaaattctcggccagttgaacatcgggaaatattggtattttcttggatcagcagtgtttgttaagcttaaagtataaccgcttcttccgtgaaaagcctgtttgaaatggatacagattccagcttcagtatcaagtcctttttcaaagtttttgcgggttttccagtcgaagcatgctttcatcgcattttcaacgcccaatgttccgccttcgataaagaaagcatattgtaattcctcaggaataaccactctctcaaacacctcaaggaaatgggcgtattcttccgaataaacgtcagccaaagtaggtttgttcacagccattcttcccagccattctgatctttctacaagataagggtggttatatccgatagacgccgatgcaaacatagaaaacatatccaggtattctctgtctgtaagcttatcgtatagccatgaaccgtgtgatttttcaatatccatcacaaaatcgaagccgtcagccagtacatgtcttcctactgtttctttaactttatttacttttatatctaatgtttgttccataataaattgtagtgtgatttaataagtgaatgattaaatgatccaaagaatgaagcatttaatcattcaggttattaatttttttgtttttaattactttaaagctatgcttttataaatcaaatttaattccttgtgccaaaggaagttgagtagtataatttatagtattggtttgtcttctcatatagtacttccaggcatctgatccggactctcttcctcctccggtttctttctcaccaccgaaagctcctccgatttcagcacctgatgttccgatattaacgttggcaataccacagtctgaacctgcgtgagaaaggaataattccgcctctcttaaattctgggtcatgattgctgaagataatccttgtggaacatcattctgaatagcgatcgcttcttctaatgttttatatttgataagatataggattggtgcaaaagtttcatgctgaacaatctcataagagtttttcacttctgccacacaaggcttcacatagcatccggattcataatcttttccagataatactccgccttctacaacaaattttccaccttcttttttacatttcttgatggctgcttcatattgattcaccgcatcagtatcaatcaacggacctacatggttggtttcgtccagaggatttccgattttcagctgaccataagctttcgccagtcttgtttttacttcgtcatatacactttcatggataatcagtcttcttgttgaagtacatctctgtcctgcagttcctaccgctccgaaaacagctccgatgatcgacatatcgatatctgcttcttttgtaatgataatcgcattgtttcctcctaattcaagaatagactttccgaatctttctgccactttggaagaaaccattcttccaactcttgtagatcctgtgaaagaaacaagggcaactcttttatcgtctactaatttctgtccgatttcgtggtctgataccagtacgcttgaaattccttcaggaaggttattttcctttaaaacttccatcatgatattctgacaggcaatagcacaaagcggtgttttttcagatggcttccagatggtaacgttaccacagatccatgccaatgctgtattccatgaccatacggctaccgggaagttgaatgctgtaataattcctactactccaagcgggtggtattgctcatacattctgtggccaggtctttcagagtgcatcgtatatccctgaagctgtcttgaaagtcctgcagcaaaatcacagatatcaatcatttcctgaacttcaccaagaccttcctgcagtgatttacccatttcataagaaacaagtttaccaaggtcatctttatattctcttaattttaagcccagctgccttacgatctctcctcttttaggagccgggatcagcctgaattcctgaaatgccttttgagcagtttcaattactttgtcataatcactttctccagaagtttttactttagcgatcagttttccgtctacaggagaaaagctttctattacctttcctgaagcgaaatattttccgcccactgaagtccctttgttctcttctttgataccaagatttctaagtgttttttcaattccgaaatcctttactttttttgacataaaatcttacttttcgttctctctaaagataaaaatattatgtgaacctcaaaactttaatttttaacaagctttttatttggactaattataaacatgcttatctttgcagagtaatcattttgataatcaccaatggaaaattcacaagaaaataactcaaagcttaaaaagtggttcaagcgtgtgggatgggctggattagctttctttaccattaaaggcttgatttggctggtcatattctacgttggagcagatagtctccagagttgtatacaataaaaaagcagagaaaaatttctctgctttctttttggtataaggttaagtgaattgttatttctttattgaaaagctaaaaaaagaggtcttttttatgttttctgtaatttaaaaaaaagaggatatcataaattttattaaaaatattccccaaaaagattattctttttcttaattcttccttttaaactactcctttttctttctccccgcattcacaaggctttgatgcaacaggtattctatctgtccgtttacacttctgaattcatcattggcccacttttcaaggagtttataagtagactcatctattcttattacaaaggattttttgcctttgctttccgaagagttctgagctttttctgatttcattttctatttctctagcattattcttactatttcagtggagaaaccctctgcactaaaaccgaattattcaatttcacttcttaattataaagtgttccagcatttaatataggagttgctgctttttcaccacaaagaacaaccattaaattgcttaccattgccgcttttctttcatcatcaagatcaacaatattttcttcggatagctttttcaatgcaaggtctaccattcctaccgctccttctacaattttggttcttgcagcaacaatcgcagttgcctgttgtctctgaagcattgctccggcaatttctgaagcgtaagccaggtgggaaattctcgcttcctgaataattattccggcttttgaaagacggtctgtaagttcctgctccaaaatagaattgattttatcccctccttctctcaaggtaataggagcatgatcatcttctaaattatcatacggaaagctcatcgccaaatgccttacagcggcttcactctgcattcttacaaagtcagaataacgttctacatcaaaagcagctttataagtatcccccactttccatacgataaccacagcaatttcaatagggttacccattttatcatttactttcaatgtctgtccctgtaaattttcagaacgtaaagaaattttctgtgacgaatacaagggattgataaagaataatccgttctcttttacacttccgacatattttccaaagaagttcagtaccctcgaatggttaggctgaataatcattaagccctttaagaaaaagcatgacagaagaaagcaaagcattgagataacaacataggctatactttgatctactccgctaacaaagaaatagacagccgcggcaaacaaggcaagacagataaccagtgtaagatagcccgacatgggttttaatgttttttccatgatataattttattttgatattattttgatatcataaagatagtaatcaattttgaattatgaatgataaattttgtttttttgaggtgcgaggttcgaggtttggggttgcgaggtgcggaatataggattcggtattttagataacgcaaagttcgcgaggttaatctattaggatgcattatatttttgttcgcaaagccacttcgtttagctaagatcagtaatttctttgctgagtaaaacgtctttgcaaacgatatttatcatcataaaatcattgcgaatcttggcgttagaattcgagttctcagtatttaatttaacgcaaggatcacgaggttaattttattgggatacatcatatttttgttcgcaaagccacttcgtttagctaagacaagtttatttgctgagtgaaacgtctttgcgaaagatatttatcatcataaaatcattgcgaatcttggcgttagaattcgagttctcagtatttaatttaacgcaaggttcacaaggttaattttattaggatgcattatatttttgttcgcaaagccacttcgtttagctaagatcaataatttctttgctgagtgaaacgcctttgcgaacgatatttcatcccaatacatgctattgcgaacttagcgtttataaatactcatcttaaagctggaaacattatgaacaaaaaaaatcccggaaaacgaattccgggatttgaatttatatgttcagctctttatttctttgttaaagttttaaacttccagtaagaaacagctgataaaataatcattgtagagattccgatgtatacccatgccggtaccggtaccggatcccctgctgcatatgagtgaagtccgctcaggtagtaatttactccgaaatacgtcattaccattgagcagaatgcaaacatcgttgctacatggaatgcccatctgcttcttaatcccggtactaatctcatgtgcaatacaaatgcatataccatgatggaaatgaaagcccaagtttctttcgggtcccagctccagtatctaccccatgattcgtttgcccagattcctcccaagaagttacctaccgttagtgcaaacaatccgattgtcaatgacatttcagaaacaatgaccaattcctttaatgttgtatcgtggtgaatcttataagtttctttatttgaaataatataaaacaccaaagagattacagcaataatcatcgacagtgcgaagaatccgtaactggaggtaataattgctacgtgaacaatcagccagtaagacttcaataccggaacaagcggtgtaatttgcggatcaagtgctgaacctccgtgtgcaaatcccatcatgataaccgctaccatgaatccggctgcaggaatcaacgcattggcatttctgtacagaattaaacctgccgtgattcctacccaggagataaagataatcgcttcatacccgttactccatggagcgtgtcctgagatataccatcttgccacaagtcctaagaaatggcacagatatccgattaaaccaatcgcaatgattactttaattactttgtttaatactttatttgatttgaataattcaacaaatcctaagatcagaagaagtcctccgacaagcgtgtagaagatcaacaatttgaagttaatatctactttattcatgaatacttcaagatcaaccttggattttgcaggaactactgccttaccccatttctgctgatagtctgaaagctttttcaattccgcatctgctttgctccagtctccggttttttgtgccgtaagagcttccgcaaagtatggccccattacctgctgagattccatatccggttcaaatttctgatccagccacgagtgccatgtatgattcgcatcatttttcacaggaacaattctcataaactgaccgctgaagaactcattgaagatctgtactctttcgtttacagcaattacttctttatcgtaattcgtttgttcagccggtttcttacggaatgcggtgttgtaatcatgttcaagaatgtaggtaagattaccgtttgcatccgcagggaaaagattcatcagagaagtataaccatcttcatccgcttttgttttattcttcagctcatcacctcctttagttcctactttaataatcggaaccattgtccagcttggggtgtctgtattgatggaaaggaaccattggttggcagtaagatacttcccgtctgttcctttaaatttgtcttttttgtatagttttcttaaaatatctatagcctctgtattgatcggaacaattcttccttcataattctgtaccagaagatatccgaatttatcagcatgttctttactgattttgtttcttgcaataatctcatccggggaaatcattctcattttccccattggagttgccagagagttttgtttcggagcggcaccatcaagaggctgggcagacggagccggagcatgagtatggttatcaccttctaaatggatatgctctctgctaccatcagttgttccgtgagtttcaattttctgagcatttaaccctaagcttaagaacaataaaagtacacctgctgctttctttttattaacatcagcaagcattttatttagtttccagaaatgagttcctttccagaagaatattacaaacatccctaagaataaaagtgcatatccgatgtaagaaatcaaagttccccagtaatcgtggtttacagaaagaacggttcccattctgtccgggtcaaagcttgactggaagaaacggtatcctttatggttaagaacgtggttcatatagattttataaggcgtttcttttccttcatcaatgatcttcacgtggctttcataagcacttggcgaagaacttcccggataagtttccattacgaagtcatccagtttcaaggcgaaaggagtgttgtatattttaggtccgaaacctaccataatgtttaagccatccatcgtaacctgcttgtaagcattcgggtttcctttttctacagaaagatctaccagctgctttgtttttggtccctgaagctcaacctgaagcatatccggtacgtttgcatctttttttctgtctccttcaatcgccatcagccttccttttttaagaccttcaggaactacaagcttcagctcattgatcgtatataaacttcttaatgccagcggctggaattcatcttttacagtagttccagttgcctgggtagccatggtcatatagcttgcatctacaggcgttttgatgaatagttttccaccttcatttttgaactcaacagctccgtcaatcgctctgttgaaagtcaccaaagttccgttgatcgattttgtctctcccggtttaatataaatattctgtcttccggtgtttccggtagaaacgagatgaagatactctgtaccgtttggctcagcaacaaggctgtccttttttctctgaatgtattccttggcaaacactttcacttcttttccgtggaagtcataagttgcctggaaatctttgtgtaacggcgacatcagataaggaacatcctgatagttaagaacatctcctttttcctcaatctggattttaaagaaatttttatccgttacaatttcgttggaggtttcaccctctctgatatgcatttggccttcgaaactgatgtatctggtgattgcacctccgataaaaataaaaacaaaggcaaggtggaaaacaagaaccggccatttatcctttttccaaagtctgtatcttccgatatttcctatgaagttaagaataagcaggaccatgatcagttcgaaccacttggcctcataaattaatgcttttgctgtaggagttccgtagtcgttttctaagaacgttgcataagccatcgcaaatgcgtacaccagcaacaatacagccattgtcctggttgagataagaatatcttggagcttcttcatgatttattgtacttgacatgcaaaaataagcatgataaaccataaagagcttaaaaaaagctgttttttgtcactttggccttggttttgcttattttgaaacgttcttaataagcttgaaaatattaaggaaaattcaatttttaaaaacctcagaattcagattcatattacctatccgggtaatcgaagtattctatttaaaattcatctttattttaaaacttctgaaaagaaatgtgttaacaattctttattgatctccggattataaatgaaagcatgagatcctttctccagggttttaaatttccatcctgttgccttggatttattttgattataaattttaaagacattttcatagctgaaaacatcatcatcttttgcattcacagtatacaacggatgcttttttgtgatattctcaaatgaaacatccccgatattcaatacagggttgggagcaaaagcataaaaagcccggaaaggtgtctttttctgtgatgcaaaccagaaggtggcagttccgccgttagacattcctccaaggtatattttattccggtctacattatattttttctcaatatcatgtacaattgtaaatatatttttaaatgccttcttctggtcaacccatccaaaatcttttttagcaaaaggataaacaataatggcattaaaattttcccctactgaaaaaatgggttctgttttgacgtcagtatttttatagtaaaaatcattcagtgaatttactcctccatgaaggtaaaagatcactcttgtttttgcagaagctttataactcttgggaacgaaaacaatatatggaattttcataccttcagtttcagtaaaatacagggcaaacccgggtgaaggctgattgaagggtttattttctgtaatctgattacggataatctcctggttccacagctctgcttcttttcttttatcctcttccttttgagccagtttattttccatacctgttataatctgctgaaattccgtatcagaagtaagatttttaaatctttcattggttttcagatagattatttcatcacggttttttcctaatccaagctcataacttttttttaaccactctactgctgtttttgtatcactgcaattggcggccgctgaagcaccacttacatattcatagactccaacttttgcctgcgggccaaaagcgtttttaaaatctgaaagtgcagcacaatactcctttgcttttaattttttggaggcatcctgcataaaactttcataagattgagaaaacatactcgaaaaacaaagcaaacatggcaatactaaagttctcatggtatttttttatttcaaaaataaaaaatattcatattcaattcattgacttgaaattttctttcttattttacttaaaaactcatgggtaattcccagataagaagcaacctgctgctgggtaattctctgttccagtcccggatacttttcaagaaattcaagatatcttttatcagctgtttttcctgttaacgaaagaattctcctttgcagtgctaccgaagatttctgattcataattctgaaaagcttttctgtctttggcattgtttcgtatagattttctttctcttttttggaaatcatcagcacttcactgtcttcaagagcttcaatattcagaatactgggaacattattgataagactgtcaatatctgtaatccaccagccttcaacagcaaaatataaggtttgctcaaaaccgttttcattaagataatagattttaaagcagccactcagtacaaaaccctcaaaaaggcagtaatcaccttcttggagaacaacctctttctttttaaacattttgagtttaaaaggctttacaaactgctgaaaatcctcttctgaaagattgatgtattgactgatatttctaaaaagtaaatcggacatggaattatttaagcaaaataaaggtatcaaaattattgacacctttattgataaagttatgttaaatcatttttgtttggtaaacgctaaggcgcaaagttttatcatacatattgtttattttaagacgcaagaaaatcgaaggttttcagcaagatgacttgtttttaaattttatcggagataaaatctttgcgccttatagcaaaatttttaatatcattttgcacctttgtgtatccaaatatgcccacttttaagcctatttacttaaaaattcttttgtatttattactcgggcataaagatttccaagagcagatatcgccgccaggaaggatctttgaacttcttcagcctttagtacttccccattcagttcacgatttctggttgcagtggcatcaccaataacggtattactgaatccgaaatcaaaagccgctctggtagtagattccacacagacatctgtcatcattcctgtgattacaagacttttaattttctttgactgaagatagttcagaaggtcagtttccctgaagctgttgggaaaatgtttggtaattatcttttcattctccttcggtaaaacccgattattgattttaaccccatctgtatccgggagaaaaaaagtagccccttcgttggtggagatatgctgaatatgaatgacaggaagatgattgttcctgaaataatctaatactttccggatattttctgcagcctgttcagacttttccagggtcatttttcctcccgggaaataatcattctgtacatcgataattaatagtgccgtgttttccattttttgttgttgtgcgttcattgtaatcattgaaattaatatcagacctgaggtcagaataattttgaatttgtttttcatatatgaaatcttatgagacaaaattactcaggtctcagctgctggcctttgaactagttcaaaaaacacgattgcatattatattatcaaccagatattcaatattgttattttttttcagctatatatatttagatcgaaaattttattatcttttttaaagaaaaacgaattataattaattaatagtatttaacggtatcagatttggataagcaaaaaaaataaccttattttatcgtattaaaacataaaataatttttgagtaaaaattttaaataccctttataaaagctggattacccaaatgttttttggataaaaaagattcatttaatgttgaataaaacattaaatttgcgacattgatattatggataaaaagacacaaaaaaaaccgactgaaatgcctgaaaaaggcagaattttatctaagccacgtatttttttcgggcttacctttatacttttatctgctgttcttgccttctcattcatctcttacctgatgaactggaaagcagatcaaagccaggcagggactatgctggacaagagtataaaatcttccaatatctttggtaaggtgggtgactggcttggtaatattttcatttttgaaagtattggtatagcctcatttatcatcgcatttttgctgcttgtagtaggaacactgatccttaagaagaaaatattcaagccatggaaaaccattggccactctctgttttttatctgctggcttcctatttttatgggagcacttaccaaaggtcagggtgttttaggaggtgtctatggatatcagattatggattatcttaattccatcattggctctgtaggtctttggaccgtacttgcagcaagtatcctgttatattttatccttgaatttaatcttcgtcctagttcaatcaaagcgaaactgaataaaattaatgaaaatacgattggaaaagtaaaatctatgatgccggactctaatgaagatttcgaagcggatgaggaactgaaagaagaagctgaggaaacagaagaagaaaaagaagctgctccccgtgttacagtaagtgatgttaccaataacacatccaatacttcagtgaatgtgaaaaaggagccggagccggtaagtgttccgaaaggatttcctgaagttcccgtttcgtcagatatagaaaccattaccactccaaatcatacttcttttgatacttttgatacgaatccgggcaatacttctgagccggtaagtttaaacctgtctacaaaaccagttgttcctgtatcaactcccgaggaagcatttgacatcagaccttctgctccatctgctgttatcacaggttctcaggtgaaggaagatattaagtttaacgtagaagtcgctcctgttattgatattctggatgattccgaaaaaaaatcccaggacctggtagaaaagcatggtttatatgaccataagctggatctggccaatttccagatgccacctgtagatctgctgaaagattatggtaatgaagagatctccatcaataaagaagaattagaagaaaataaaaataaaatcgttggacttctgaagaatttcaacgttggaattgcagagattaaagcaacaatcggtcctactgttaccttatacgaaattgttccggaagcaggaatcagagtggcagcgattaaaaaactgcaggatgatattgcattgaacctttctgcattaggaatcagaatcattgctcccatgccagggaaagggacaatcggtattgaagtaccaagaaaaaatcctacaatggtttctatgcgttctgtaattgcttcccagaagttccagaatacagatatggatcttccggtggttttcgggaagaccatttccaatgaaatttttatggctgacctttcaaaaatgccacacttactgatggcgggagcaacgggtcagggtaaatctgtagggattaatgccatcctgacatcccttctttataaaaaacacccaagtgaactgaagttcgtaatggtggatcctaaaaaggtggaactttcattatattcaaaaattgaaagacattaccttgccaaacttcctgatgcggaagaagcaatcatcacagataccaataaagtaatcaatacactgaactccctgtgtattgaaatggatacccgatatgaccttcttaaaaatgctttctgtaaaaacctgaaagaatacaataagaaatttgcagaaagaaaattaaatcctgaaaacggacaccgttacttaccttatattgtactggtagtggatgagtttgccgatctgatcatgaccgcaggaaaagaggttgaattaccgattgccagacttgcacagcttgccagagccgtaggtattcaccttatcgttgccacgcaaagaccttctgtaaacgttattacaggtatgatcaaggctaacttcccggcaagagctgccttcagggtgatctccagtgtagactccagaacgattcttgactctccgggagcggatcagctgattggtaaaggtgacatgctttatttcaacggaaacgagatcttaagacttcagtgtgctttcgtagatactccggaagtggaaagactggcagaatttatcggagaacagaaaggctacgcttcagcgttattacttcctgaatatgtttctgaagattcaacaagttcagtaggcgcttttgatccgaatgaaaaagatgccctgtttgaagaagctgcaagaattattgtttctacacagcaagggtctacatcaatgcttcagagacagttgaaactgggttacaacagagccggaagaattatggatcagctggaagcaagtggtattgtgggaggattcaatggggctaaggcgagagaggtgctgatcagtgatctacattctttggaacagttccttgaagatttaagaaactaatcattatattataacaatcatcaatacaaagattaatcccggatactcctgactgggtaccgggatataaaaaattcaactcaaactattaccatgaaaattaccctaaaacaaactattacattgagtctttttgcatgtacattaacattatcatcatgcgccttaagaactgttcccagtgattatgcttctgtgaaactggatgttattgataataacactctgggaaatggtaaagtccttatttataatggcgccggaattctccataaaatggataacacagcaagattgaatatcggacttgacggcaaatcattaggacagataaggcccaaagaatatgttattgttgatttagcaaaaggaaaacatgagtttacagttcttcatatagatatggtgaatatgagaagtaaacatccggttgagattaatgaaaacactaaagtaattaaaattgaaccaaccattacttctaataaattaactgtcaccaatatgctccctgaaaaatttgatcagtacattgaaagaccggagacaaggtaatctgtaaacaatatctgtcatacagtatccggcattgaaaggtggattttggaacagtttttggaagatctgcgtagttaaaggaaaaacacatcgttttaaccttaagaattaaagtaaatctaacgattattaaattaagaaaatgaaaaatattatttcaaaagttatattgggaagttttgttgtaggtgcagtaggtatggccaatgctcagaagattgatgctaaagctaaaaagatattggatgatattacagccaactataattctaaaaagaattcttacttcaaattttcttttggaagcggtcttaacggacaggtgacaaaaacagaacccggtatttattatgttgccggagaaaaatacaaactgaagatcatggatacagaacagatcttcgacggtagcaaaatttacaacatcaatgctgatgatatggaagtaaccattgccaaacctaacggaagcagtaccatgttctcccctatcaattatcttaccacctacagaaacgattataatgtaacctacaacggtaagaaaatggtaaacggcgttaatgctgactttatcaaactgaccccggtaaaaacaaacggtataaagtatgtttatctttttgtagattcagtaaagaagcaaatggtaaaacttgaacagcatggaaccaacaaagatgttgcagtaatcgctattaaagaatacaaagaaaaccaggagctggatcctaatatgtttgtttttgacaagaataaattcaaaaactacattataacagaactttagaaggtaaaaggcaaaactgcttatccgcaaatttgcatttttacgatttagtttaaaaaaaataacaaaatataaaaagccacaagtaaactttgtggctttttgattaattttggcgcatgttaaaaatactagaccgatatatcataaaaaccttctttggaccgtttttctttatattcagcgtattgtttttcatttttattgtaaacattatctgggttcagttggggcagtttatgggaaaaggattaagctactggcagatcctcaaacttcttttttatcttggggtgaacgttatcagtatggttcttccgcttactatcctcctggcgagtattatgtctttcggtgaatttggagaacgttatgagcttgcggcaatgaaagcggcaggaattcctttgaccagagtaatgactccccttctgggaatttcaacagcgcttgctattatgctgtttttcttttccaataatatcattccggattttcagaagaaagctaaaaacatgcttttcaatattgcccagacaaaaccggccatcaactttactccgggacagtttatcgatcagattcccggctatatggtaaagtttgacaaaatatacggggaaaacggggaaaatattgaaggggtttttgttcataaaaaagccaacgcttatgaaaaccagcaatccgttgttgcagaaaaaggaaaatttgttcctgccgctaataagaattacctaaagcttgtgctgtataacggatatgtatttgaagacgcttttgccggaaaaggagataatgtaagacagaaacagcccgaccaggccattaagtttgacacactggtttcccatttcgacatcagtgaaatcatcaataaagccattgaaaaggaacagattacggacgactaccgtttccagacctataaccagctagacggaacgattaccaaaaccaagaaagacaataagcagttctttgataatataggctctgaagtccttaatcagaccaattctgttattacctatatggataaaggtaataaacataaagtagctcctaaaacccagatcaagctggatacagtaaaaggtgaaaaaaaacttgaaatcatttataattcctacaacaggctggataatcttaagtctacgctggaatctaaaaagaatgagtacagttccaatgtaaaatacttcagtaaagtggttatttatcagcaaagaatcgttgcgtattcggtaacctgcattatcttcttcctgatcggatcgagtttagggtctattatcagaaaaggaggaatgggacttccggtaattattgctattgttattttcattatcttttatgtaatgaatgttggcgtggaaaacatgtcatggagcggaaaaatgaatccttatcttgcagcctggcttcctaacctgatccttcttcccttcggagtgtggatgacgtataaggcgcttacagattcgcaattgtttgatgcagaaaaatacaaagcattattcaaaccgattaccaaaaggtttacaaaaagtaaagaacatcagaggtatcaataaccctgatatcaatataataaaaggctccggagaaattccggagcttttttgttgattgttgtaaacatattccgtttcgtattattttgaatataaaaaaattatatttgtggaaacttaaaacagaaccatgaagaaattactacttattggcttatttagccttgtgtctctgaatgcttatgctcaggatgaagagaacggtacctacaacggtgaaaaatacggatacatcatcaataaagccggaaaaaaaattgaaggggttgtgcatctgcatggcggctactccagcccgtggcaaaatcagttaaaagtaaaattcgctgccattgctgatattgataaagtaaaaaacaggattaagtttaaaacttatgatactgacgatatcaaggaatatatgctctatgaaggtgatacgcccagggtttttaaatctgtaaaatactctaatatgagagaagccttaaacagttctgaaagctcaacagggctcgctgcaggctttaaggcgatcaataacctttcaagaacggaacagtttgcagaagtggtaacagaagggaaaatcacagtgtataaactttacggctaccctactgctctttccgcaaacagtacacaggctatctctcaggcagaaacagaccggttaagagaaaatcctaattatatattttcgaaaaaaggaggaaaagtagaagaactgactccggcaaaggccaaaattatcctggcagattgtccttatgtaaaagccaaaatagcaaaaggagaatatggttccctgaaaaatgaagaaaagaaaaggtccggttttgggaaatttatccgggatgaaatcagcaatgctacagtagataaactttcaatcatcaatgaagttgtttatgattataacgaaaactgtaaataaatactaaaataaaaaaggctgtctcctaacaggaggcagcctcttaattttaaaactgataaacaaaagcattaatgttcattccagcccctacagacgcaaataatacgatatcacctttgctgatcttatgatgttccagctcatcctgcagaatcattgtcagtaaagaaggaatcgtagccacactgctgtttccaagtttatggatcaccataggcatgatgttttccggaaccggctttccatataactggtaaaatcggttaacgatggcttcatccattttttcattcgcctgatggataataattttattcaattgctcaatggaatatccactgttatcaagacattttttcatggcatccggaacatttaccagggcaaattcgtagatttttctgccatccattttgatgtagcgggtatcaggacatctttcgttgttgtaagattttccaaaatacagataatctttttcttccaatgtataggaagcggataagtgagctttaataccggagtcatcatcattattgacttccagaacggctgctcctgccccgtcagcatagatcatgctgtccctgtcatgaatatctaccacgcgcgaaagggtttctgccccaatcaccagacacctttttgccattccggatctgataaatgcatgggcctgtatcactccttcaatccaacccggacatccgaaaaggacatcataagccacgcagaaattatttctgattcccaataaatgttttacccttgctgcaaggctgggtaccatatccgactgaaccgttccaaagcggacatctccaaagttgtgggcaaagataatatagtctaaagtttccggatcaatttctgaattttctatagccttctttgcagcaatatatccaagatcagaagtaacctgtgtattgtcggcataccttctttcttcaatccccgtaatcttcttcagcttatccgtaatggaagcattattctcttttaatacgactccttcttcattaagaaaaacgtgtttatcaaaaaataaattggttatggtttccgatgggatgtagtttcctaccccgataatttttgtcatcattattgtaagtttgttacctgttttttaatcatatctcaggattatttattaaatataatgaatgaacgtaaatattcatcaatatcgtatgaaataagaatgtattgcattataaaaaatgaaaaagaacaggaaataaggagcacagcaagaaaaaagaggcttcctttcggaaacctctcttattattttatttttcaaaactgaaaattatactttcataatttcagcttcttttgtcttaagatgctcatcacaaagcttaacatatttatctgtatacgtctggatttcttcttccacacctttgataacgtcttcagaaactccatccagttttttaagttctttcaaaccatcctgtcttgcgtttcttactgtaactttagtttgttctgcttcagcttttgcctgctttgcaagctcttttcttctttcctctgtcaaaggcggaacgttaaggatgatattttctccgttgttggaaggtgcaaaacctaagttggaattgatgatcgctttttcaatcgcattgattgcagttctgtcccaaggttgaatagagatggtcatggcatccggaatagaaacattcgcaacctggttgataggagtcatagccccgtaatattctaccattacatcctgaaccattgttgtagaagcacgtcccgctctgattctttgaaatgcgtgatccaggtgctttacagctgcatccatgtcttgttttacagattctaatataagatctaattcttccattattatagtatagtttgataaattacacatctattaatcagtctgaatactcattaaagccaaaaaaacctgtaaacatcagtgtttctcattacttctaatgattttttactattcagtgctgcaaaaataatgattgttttcgatattttggtaagacagcattctgtattttgtaaaacgttgatatttttaaaaatgacggtatataaaattattttattaccagtcgttacttgtttcttgttttggtcatgtggatttaagttgtgcaattagggagatgattttttaatgagttttttgttttgtatcctgccaagtattattattttaatcttcaatcaattccaaaacatttctttgcacttaaaggaaaagaattaactttgaaataaaacaaactaatggaaaatattgaagctaaattagacattattgaaaaatggttttctgtcccttcaaaaaaacttattaatgtttacaacattgtaaaagaaaaaggcattatgagttccgaggattaccaacaaattactgatattggaatcccgattattaacaaactatcaaatgctacaggtttatcaattgagaaagtacgcactacaataatacaaaaaggaatttcctttaattatttccatgaggcaataatatcttactctgaattctgtacaaaagaaaaataaaataaagccccaattaaggggcagtttttattctataaaatcaacaaactcgatattacttgtgtttaaaattttacttttaccttcaataatttcatgtagatgttttattgggatagcaataccataacctaagtcatcataatcatcttttaaaccaggaagattagttgctattccgactacattgcctttgttatttataattggcccaccactattgccgcctttaattttagctgtaattaacataagatcttgtctaatccatagatcttctgataaggacgcaatagtcccaacagaaggagtgaatcgtgagcttattgttgctttttctgcggtcataaaagtatgaaagcctatcacctttggaaaaccaagtgctaaaacctcatctaatacttgaccttcttcagtttcaataagagtaaaatcttgatcgaatccttgtggaaatttaataaacattaaatcaattttttcattttcgtgaaccagaaactctgatgcttcaagtacttcctttgggatatctttaatggatagttttttcgcatgctcaacacaatgcttagcagtagcaattccgtcatgaaataagaaacatgttccaattccagggtctttatctaagtaatgacatattgggcgtacgatgtccttgtagctttggtttatatatttaaaaccataaactaaacagttcaatctttcattgactatgttttttagagtttcatttctaaaaagttttccctccccatcagctggtagataaatatatgtatcatcaaaattgtgaggagtatctttaacaacaactgataaatatttatttttaacaagtatctcacatattccggcaatacttgaaaagggaggcatttcatcaggattatattttgaatggtagtattggcaaaattttacaattgttcttctttcattattttccacagttcggccaatatcatggtgtgcagaaaagtactctaagatttcaataagcaaattttcgtacttgtaggggtattggtcaaattctatcatcttttttggttttagtttcccacaaatataacaaaaagccctctcaaagagaaggctgtagatctaaattcttgaatgtttaagagtaaattttttgaacctacttccatacacaaactttaggtgatcacaacattcatataaaaatttgttatcatcatcccattcatcttctgggcctaattgtaaaaaaccatagatttttccacctacatctgaaacatgtaaataatgtttcgtttcattaccatttttaatggttctatatattatcatttaaacaattccccactgttatacgggtactatctctaatataatgattttacttttgaaccacaactaattataaagttttttatattttttttgcatgaactggcatctcttacttgagctccatatagatttgtccgcttatcttttcttgaaaaaaggatttttttctattctttttaagcaaggaatcgggtagaaatacctacaggatatttcggttatttctactctgtgagatatcattttttctggcttcctttacaatgtctttttaaagatgattcttgaggctcttccatggatacctccatgatcaacagagagtcttgaagaagacaatatttaatgattataaactaatttaaaccagacacatcatgacaaatccatctttagacgcataccaacaggtttttgcaatgtcaggtcttgccaatcgtgccggaggctacaatggtaccggcaccgaattacagcaacagcttcagtatgacctatctttttatttcaacaatgttcctcctgttaaaataatgaatcagactacaccatcaacagctgatccttcagttactccggtattgggagactggaatcttgtttggggccctgctctgattgaagaaaccgacgaaaatggcaaacctacaggggttgcagataatgctttgtatgtagctcaatgtgacacagtcgcatttccgggagggcctgcagttcctgcctacgttgtggctatcgcagctaccaatccatcctccctttacgactgggaaacagaagatttttcagtatccgaggtggtcaactggacgacgtatgatccttccaattttacaccatcaccgtataatggaactgatccctatatttcaaaaggaaccgctaccggtgtaggtatactcctcggacttataagcccggatacggccgcatcacctaataccacactccagcagtttcttgccggtttaaatccggatccggatacagccattattttttgcggacacagccttgcaggagcattatcacctacccttgccctctatctgaaagagaataaagatcttgatgctttcgggataacactggtatatcctactgccggacctactccgggtgaggcagcgtttgcaagcctgttcaatactacatttccaccgttacctgccggatggcaggcccagacaggagattatcagagctggaacaccatgcactggaacgatctggatgtggtaccacatgcctggccggcagcagatctggaagagattgcaacgatatacggcaaatctcctgacaggcttactgcctttacactagataccttacagaatattgctcttgctgatgcttccctgtcaggtgtaacctatacaaggatacaaaaccagtcactcccaggtaaacttcagaactcggatgggcctggtgtcagcatcaatacaccaccccagtctttgtatgattatatgtaccagttatttttgcagcacgtagatatgtactcgggtatcccttcctttggtcctggttatcctcaggtaaacggccttattctgcaacagccattgccccagcctcagcagatgaagctggtaccgggagtaactgctgttacaaaatttgagatgattatgaaaataatcaatcagatcatcggctggatttctcttcgttacgcggcaacccagggaatcactcaacagaacgttgaagtgaatgaataattaaaattataacttaaaccaaaaacacctgtcaaagctaggtcgccatgacaggtgtttttatattattctattgatacaggctgattataaatcaacaagagtacctacattttcaccatctacaattttttctaaatttccatctttattcatatcgaatacaatgattggtaatttattttcgtgactcaaagtaaatgcagtcatatccattactttaaggtttttctcaaatacttcatcaaaagataatgaattgtattttacagcatctgcattcttttcaggatcactgtcgtagattccgtcaactcttgttcctttcaggatcacatcagcaccgatttcgatagctcttaatgtagcagccgtatcagttgtaaaataagggtttcctgttcctgcgccgaagattactactcttcctttttcaaggtgtcttaccgctcttcttttgatgaaaggttccgctactttgtccatttcgatcgcagactgaagtcttgttttgattcctgcatcttccagtgctccctgtaaagccatcccgttgattacagtggccagcattcccatataatctccctgtactctgtccattccttttgctgctcctgcaacaccgcggaaaatatttcctcctccgattacgatcgccacttcacatcctttgtcaactacttttttgatctctgcagcatacttctgcagtctttcattgtcaataccgtattgtctgtttcccattaaggcctcaccgctcagtttcagaaggattcttttatatttcatcttttatttttaataactttttattagtactggtttcccaggaatttgattttgcaaatataatcattaaaaatgttgataaaagaaaaatatttaaatagaaataatgtaagaaatattttgaaaagtacgaaaaaggattatttttgcattaattataaattgaattgaagaaaattatcattttttcattatttctatcaggaattgtttcttatgcgcaaacaggaacaaatgtttatccgttcttaaatgtacctgtatctgcaagacaagctgccctgggcggtgatgcaatttcagtaagagattatgatgtttcctttgctattgcaaaccctgccctgttaaataaagattctgataaacagctttctgtaaatgcaacggcataccttgccgattcgaaatacggaacgattgcttatgccaaagactttgaaaatggccatatggcgaccatcaatgcaaggtatatgagctatggaagtattccgagaacggatgaaagcggtttcgaaaacggagaatttaaggcttctgatgtcgctattggtgcaggctatgcctaccagtttgaagaagactggactattggtggaggacttaattttattacctcaaaaattgataattatacttcttccgccatctccggaacagcgggagttacctatcataataaaaagaacaaagaggttgtttcattggtgatgagaaactttggctttcagctgaaatctttcaatggaacaagagaaaaccttcctttcagagtagatctgggatacaccagaaccatcaagaacttccctcttgccattactattacggcacatgaccttcagaagtttgatatttcttcagaagaaaatctggacgggcaaaaagtgggtaccggaagaaagattgccgatcacttttcattgggagcagaattgttcccggaaaagaacttcaatatcagactgggatataatgtaaaaagaggaaatgagctggcggtggcagatcagagaaacttctcaggcctttctgcaggatttggagtcaaagtgtccagattccgtatagattatgcgcacgttagatatcacaactcttcaaatgtcaatcagataggaatttctatggacctttccagccacagaggagaataatcttcaggcctgaaatttcttaattattccgaaatttttttacttcttcttgatttttaagaaaaaatcttgaaatttgcagtatgaaaaaacctgtaattgctatcgatgggtactcgtctaccggaaaaagttctatctctaaaatcattgctgatcaactgggacttattcatatggatacaggagcgctttacagaggagttacctggtatgctttgcagcattgtgtgaatgaaaacggtgaaattgatctgaatacactgttctcttcttttgaccggattaaacttgaatttaaaaacaacgacggcacactgattctttttcttaatgattctgatatctccaaagaaatccgtaccaacatcgtatccgataatgtaagtcttgtggccaaacaaaaagaagtaagagacttcttgctacagtcacagcgcactttggcagaaaaaggaggtgttattatggacggacgtgacatagggacagtagttctgccaaatgcggactataaattctttcttactgccagcatcgatgaaagaaccaacagaagatttctggagctgaaaggcctgggcatagaagctgataaagaacaggtaaaacaaaaccttatagaacgcgacaagatcgacagtgagcgtgagatagccccattgaagcaggctgaagacgccattgttatagataattctgaactgaccaaggacgaaaccatagcccttattttatctcacatcaaaaagatttaacaatttttaataggcttaaagcctcctttggtatacaaattgtaagttttattactgtaaaaactaatctattattaattattaaaaaacttaaaatgtctagaaaaggaaataatacagcaggtatattggcaggacttcttgcaggtgctgcggcaggtgtaatcttaggaatgttatacgcaccggaagaaggtaaagaaaccagaaaaaaaattaaaactaaggctaatgatctaaaagatcaggcaaaaaataaatacggagaggtttctgaaaaagtaaaggaccagtacagcaatatttcttctactttcaaggaaactgctagcagcgtagcacatactgtgaaagacggatatgataaatacaaggatcagattgtttccaaaactgcagatttggcaaaagatgtggaagcagaactgaatgacctaaaaaaataagtaatttatctttttaaataaattacgggaaggaacttttgtgcgaaagttcctttttttgtaactttaaaaaaaaacaatgatagaaactattaaagaatacgcctccaagagaatagatcttctgaaaattgaagcgactgaaaagtcgtctctgtctgccgggctcattacttactttgtagtactgcttgttgcttttgctttttttattatccttttcaattttggaattgccttccttatcggaaaagcactggataattactcttacggattcttaattgttgcagggttttatgctttggtaatggcatttgttgttgcattcaaaggtaaaattgtcaacacggttgcagatcaggttattaaatttttaaatcattaaactatgggcagaaaatacgagagcatagaagaattaagaagaaagaaaaaactgcttcaaagtgaaataagtgatctggaaaatcttcttaccttcaaaaatacgaaggaaagcctgagtgcatttaccaatggcttaagcgaccagtatcttcaggaaaaaatagatgaagacggtgatgaaaaagtagttctcagaaaggatgtcattgccaaacagcttacttcagaggtaaaagaccttttgatcagcaaaaatacagctgtaggaattgcaagctccgcgttcaaaggaggaaacattacagacagccttgttaagctgggagttactgctatcgtaggaaactatgccaaaaaaaatatgaaaagctccaactggaagaaaaaactgattggcgcagctctgatttacctggctccaatagcactgaaatatgtcagaaaaaagattgaggtctatcagaaaaataaaagtgtttcaagtatggaacagcttatatagatgctagaaaccagaggttagaaaatatcagaaagtgatgtacactaatttctaacctctggtttcccgtttctatttcgaaaacagctgacctaaaataatccctgcagccattgatacattcaggctttctgtagactgggattttccaaatctcggaatactgatacttttctgcaaaagcttctccgtttccggtctcattccatttccttcgtttcctaagatcaggttgattttctccggtttctcaaaagtatagatattctccccttccatatctgttccgatgtttacattttctgttttggaaagatattccacaagatcagtatataccacattcaccctggtaaaagaacccatggttgcctgaattactttcgggttgtatacatctacagtatcttcactgcaaataatctgctcaatcccgaaccagtctgccagacgtatgatagttcctaaatttcccggatcctgtataccgtccaaaaccaactgtatattcttatctgccagttttttttcctcagcaagataacataccgcaacggaatcttttggagttttaaggaaactgattttttttaattcattttcagagatatgagtaacaggcatgtcagtacggtccaatttttgtggatcggttgacaatatttctttaactttaaagttagaattaaaaagttcacaaatgattttattaccttcaaccaaaaacaaattgtatttttgtctgaacttctttttatctaaagattgtaaaacttttattgtatgagctgtaagcattataagaattctcctcaaaaatattataaaattatctcatttgcaacatttgttggtctcctttatgcttgtagtactacgaaaaaagttcctgatggcgaatacctgcttaccaagaacactttagagttcgaagataagaaagtgtttttcgatgaggagctcaaggactacattcagcagaagcctaataaaaagcaattccttttcatgccattaagtctccttctgtataatatggctgatccgaaatacgacactatacttaatgaatatatgacctatcccggcgagatgagaaatcagaaactgagagactctttattccttaaatataatatgaagagcagcgttggaaaaagccttcttttcgaccgcttactgcacaattggggaacaccgcctgtgattcttgatcagtccagaagtgaaaaaagcgctgaatctattaagaaaagacttacctacagaggatattgggatgcagatgtaaaattcaagcataatttggactccgcatctaaaaaagcatctgttaattattttgtcagacataatgatcctacacgcatcaaggattattactacaatatcccggatcaggggattaaaggatactacaagtctttcctgaacaaaagtcttataagatccggacagattcttgaccagaccgttcttgaaagagaagtaacaagaattaccgatatgatgagggagtttgggtattatcgattcaatgcctccaatgacgaagtttattttgtagcggattctcttaaaagcaggaaacaggttcctttaacaatggaaattcataaggactcgctggataccccctataagattgctacttttgggaatattgatgttgccattgtggatgaacccggtgattatcctaaaaatacaaaaaaagacagcttaaggagaataagattccatacggtgaatgataaatataaaatttcatccatttggagagctattattccggacagtaaaaaagtctttgaccaatctaaactggatgtcaccaaaagaaatcttttggcgatgaacaactttagtatcgttaaagcaagagactctctgagacaaggtggaatgtcctcacctaacgacagcattgttgatcttttatatgtactgaaaccacttcctaaatatgaactgaaagtgggaacagatattaattattcccaggtgctgaatctggggatctctccttctgttgaccttactacccgaaatgttttcagaggtgcggaaaacctttctaccagcctttccggaacgttcggatctataagaagtacgaaggatatcagcaaaagagtggctgcgtatgaaatatcaacacaggcctcattgaatttcccgagactgctgctgccgtttaattattacaaactgattccgaaacgatatactcctacttcttctattttgcttggagcatcaatccagaataatattggtctgggaaggttaattttcaatacagggcttaattatcaggcaagtgtaaatgaccaggtatatcataagcttacgttatttaatactcaggtcagccttacaaagaataaagatgcctactacgattattttgtgaatgacggaagagtaaaagatgaagttttcgggaattatttcatgttcaatgcagaaacagcacaggtcggccaggattacaaagatggaaaactgagtgtagatgaagtttccaaacagattatcgataatgaagcttaccgtgcaagtcttaaccagcagggcacagatctgctgacagccttcagaggaactttggtcaataaagacaggcagacacaggatgtccttatttcttccatgatctataactttgtttatagtgaaatcggaaaaaaagaatatccaaatgcattttatttcaacgggaaagttgagcttgcgggtaatatcctaagcatattcaataaaaaagacaacagcggaggtgtggttaccggtccgcaaagaactattttcggactgccatatgcgcagtttgtgaaatttgacattgatacaaggaaatatttcagatttaacgggaaccagacattagttcttcgccagtttatcggagtaggaataccatatggaaactcccaggatatgcctattatcaaatcttatttcaacggaggttccaacgatatcagagcctgggtagccttcggaggattgggtcctgcagattctcaggtggatgaaagagttcgtacctatatgacggacaacttaaagcttaccaccaatattgagtacagaattccgtttaataagacgtatgaaggagctttatttacggatatcgggaatacctggagtcttcgtaactacaatgacgggtatggcgatgagtttaaattcagcaagttctggaaacaggtaggtatcggaagcgggttcggattaaggttaaacattgcttatgttactgcaagaatcgaccttgcctacaagatctatgatccgaataaacctgaaggtgaccgatggagaatcaaatacatccagcctttcaaaccaacagttaatattgcgttcgggtatcctttctaatccggagaaacgcctaaaataaaatacactacagcaatcacacgggcgaggatttccctcgcctgatttctgtaaaagctttcaggttttgtgacatcctgcgcatcaaatcccaaagcattcatatcattatttctggcaaaaaacaatgctctgaggttatgatatccctgagatacaataatgacatttttctttttataaacatctttacagcgcagaatacttttataggtattgaatcctttcggatcctccacaataatatcttccggaacaccttcctgattcaccagataatttctcatagctcccggctcattgtaccctttgctcttctccccgctcactataatctttttgatctttccgtgatgatatagaagtgctgcagcgtccattcttttggtaaaataaggattggattttcctgatctcattttaggagatgttcccagcaccaaagcgatttctctgggtggtatttttgagattttggtataggtcctcccgttggtaagcccgaaaacccacgcattacacaggcatatcatcagaatccctaattccagtgatataaacccaaggttaaatatgttcttaataactctcaactaagatcaaagttaagctttatttttttacttttcacaatagacatgcaagctaaaatatgtccctgcgcttcctctttttcggtaagatactcattctccagaagttccacttctccctcttccaaagaacattcacagctgccacatattcccgatttgcaggaataaggtaccgggaatttctgaatcagaagctgttgaagaattttatccttgttatcaggaagttgggttgtatatttttttcccagcatggtaaattcaacctctatattttcaataagaggaaattctttttctacgggataaatatcatcattgaattcttcaaaaagctcaaaatgaatgttctttttcggaatcccatggtgatagcatgcattagccagggttttgatcatttctccttttccgcagatcaatacctcgtctaccgcgtcccagatggtagattcttcatcagtatcatccaaatggagaatctgattaataataagattcagtttcttctcatccagccggccataaaaaaactgatcatcaattttctcctgtgaaaaaaagtaaaaaatctgaagcctgtcaccacatgttctggcaaggttatccaattgatcgcggtacacaagatcatccgaacttttatttccaaagaataaaaacaaacgggttctgggctcgttgtgtaggatatttttaaagtggcttaaaataggagtaatcccgattcctgctgcaaaagcaacaatagttctgaattcgcttggcttggagaccagtgtgaatcttcccgccggctcacttacccatagaatgtcacccatattgtagttttgaaacaactgggatgtagctccttcagaagagttgatctttattcccaggcttatttttccttcataaggtgctgaagtcattgaataatcattaataacctctttcccatgtgactgaaatcttatactgacatactgccctgcttcaaatctgaaattttcctttacattctctggaatatcaaactccagagaaaaagtatttttggtcagctgttcctttttcgctatttttaacggatgaaactgtatcagtttccctttatagatttgttgttccataacttcatttcaaaaatagataaaaaataatttatgaagaagataattttatccacgttacttcttactgcactgtacagctgtaaaaaagaaggtcagaaaactgaaaatacggctgctgcagattctctttctgtatctcaaaccacagaagctgaaggaagtactgttcttcccaaagaactttccccggaaaatgtaagccagcatctggcaaaaaataatgacactttatatgttaccaatttctttgcaacctggtgtggtccgtgtatgagagaaattccaagttttaaaaataaaatggaggaattaaaaggaaaacctgtaaagttcacctttgtaaaccttgatgataaggctgaatgggccggtgctgttaaaaattttgctgcagaaaacaaactgggaagcagtattatcttgctggacggacaaaaattagatcaaaacttcttccataacaacttcaaacaatgggacggaggttctattccttttactttcatgagaaaaggtgataaaactgatgaatatcttggaatgatgacggaagatgtcctgaattcaaaaatcgattctttcttaaaataaaatagactgaacgctttctgaatcatgtcaaaaagatttaaaatcctgtgtttattatttgtgatcgctattattatcagtgctgtcattaatatgaacacaggatttttaagtttaagtttcggggatttttttcaggattcagctcataaccaaattgctgagatccgcatcaaccgtgttctggttatgatgctggccggaatttcaattcctacttcaggttttctgatgcaggaatattttcaaaatccattggcaggacctgatatactgggaataacatcagtcgccagtttatcggtcgctttttatatttttttctcccataatattctgctgcctgagtttttacagaatagcttcctgagtttatcggcgattggtggaagtttactgctgatgctgatattactgtctatgtccaatagatttcaggataaatcataccttattattttcgggtttcttgtatctgcctttgctggtgctattgtgtcgctgcttcagttttatgcggaaaatcaaagtcttaaaaactatattttatggtctttcggagcgaataatatggtgaccagaaaccagatttatgtattatctgtccttgttttcatcggtatgttcatctgttttaaggctataaagccacttatcgggaattctctcggcaattcttatgcacaaagtttaggggtaaacctgaagcagcttaagcttttaattataattgcatcctctctcctatccgcttctattactgcatttctgggacctatcttatttatcggaatcattgttcctcacttctgcagattggtttataacccatccagactatggcagcaatggattcttaatatgtttctgggaatgctgatcatgctgcttttctccgtcattgcagaaaaaacacagattcctttgaatgtgataagctctgtttttggaattcctgtgattctgatgatgctattgaaacagaataaagtgtgatttttttgtttgataaacgcaaaggcgcaaaaacttttaaaaaccttatatttttaagacgcaaagattttatctccgataaaattgagcaatgcatattttaattcacaaaaaaattaccccatccttgccgaaaatcttcgattttctcgcgccttacacaaaatatcaaaagcctttgcgccttctcgcttacccgacattttgcatcaataagcaactattcatatatttaagtccaacaaaacgacacaaatgacagaaaatgaaatttcaaaaattgtttttgaaacaggtttaaagatccatagaaaaattggtgcgggattatttgagcatgtttatgaagaatgtttattttatgaattaacaaaatcaggttttctggtagaaagacaaaaattgcttccaatcatttatgaagatttaaaaatagacaatgcttttaaacttgatctactgattgaaaataaagtaattctggaaataaaaacagttgagtacatatcacctgctcataaagcacaacttttgacttacttaagaatgacaaactgtaaattggggctattactcaattttcaatccgatgttttcaaacacggagtaacaagaattgtaaacaatttataaaataaaacaggataaaaatttgacaaagtcaaattcattgcgccttaaaacattatttttgtaaaataatttgcgccttcgcgtgtaaccaacaaaagtatgcacctacagatcaaacaggcagatatcggctacaatacaactttaatttctaatgccaatgcggatttaaagcttggtgatgtatgcctgctgattggtaataatggtgtaggaaaaacaacgcttatcaagtctattcttcaccagcttcctttactggatggtgaaatctctattaatggcaaaaatgtgaagactctttcggtaaaggaaattgcagaaaacattgccatcgttttttcaaagtctgtaataccgcagcattatacagttgaggacctcatttccctgggaaagtacatttactatcctttttattttgaattaacaaaacaagaccgcgaagaagttgcctatattattgaagaactggacttaaatcaataccgatatacgcttcttaaaaacctctcagacggaaatctgcagaaagcatttatcggccgtgccattacccaaaactcgcctgtcattattctggatgagccaacaacccatctggatgaaaaaaacaaaatcatcattcttaaaaccctgagaaaactggccaaggatcagaataaacttattctgttttcttctcatgactggcgattagccaaagaatttgcagacaagatctggtatgtaaaagaaaaccatctgtattccgggattgttgaggacattttacttcagcatggtgagcttaccaatgcatccttatttcaaattaatgagacttttattccgcccttcatctcagcaccacagtttcataaggaaatgctgtattctctgctgcaaaaaaacttccaaaaagacctgtctgacctgaattttgaatttcaggacccattttgggtaatcactaaagattctgctcattaccaatgtgaatcttttgaagaaatcactaaattaattccaaacattcattaatactaggttttctttgattaattcacatactatgcatgcatagtattatgctaatcatacaatttaatctatttactatcaggttattaacaaaatttaacgttaataaatattatgcatgcataatatttattaaatttgggtaaaaccattgacgcaaaaatgatggataataataaggaaaaaatagaaaacgtagatttgattttaaagcagacctggctggctgtttcaaaaatgtacacagaattagctcaggaacatgattcaacggctgtacaggcccttactcttcttaaaatagaccctaaagaaggaacccgaagcactaatctcggcccaaagatggctattgagccaacttctttaacgagaatcatcaaacttctggaagataacggatatatctataaggaaaaaacaaccaccgataaaagagaggttatcattaaacttacagataaagggttaaactccagaaatatgtctaaagaagtcgttgtcaactttaacaagaaggtgatggaaaagatatcccctgaaaagatggaaacgttcaaagacgtcatgagcgaaatcatgaaaatagcaaacgaattattaaataacagaaaataaattatgatgaacctttcggttctatctaatcttctcaaaataaaaatttacatatgaaaagaagaatcaaacatgtaacggttcttggttcaggaattatgggaagcggtatcgcagctcacttcgccaacattggtgttgaagtatcactcttggatattgttccttttgaacttactgaagctgaacagaaaaaaggtttgaccaaagatgataaggcagtaagaaacagaattgcttccgaaaactttgaaaaacttaaaaaagcaagtcctgcacttctttattcaccaaagtttgcagacagaatcaaaatcggaaatttcgacgacgatttaccgaaaatcaaaaacacagactggatcattgaagtggtagtagaaaggcttgatattaaaaagtcggtttacgaaaagattgaacagttcagaaaaccgggaacattaatttcctccaatacatccgggattcctattcacctgctgacagaaggcagaagcgaggatttcaaaaaatactttgccggaacgcacttcttcaacccggtaagatatcttcctcttttagagattatccctactaacgatacagatcctgagatcattaatttctatatgaactatggagcaaaatttttaggcaaaacaacggttttggcgaaagatactccggcattcattgccaacagaatcggagttttctctatgatggatcttcttcataatgtacaaaagttaggacttaccgtttctgatgttgataaattaacaggtccggttataggacgtccgaaatctgcgacattcagaacagctgatgtggtaggtcttgatacattggtaatggtagccaacggtgttcgccagagcggtgctgaagccaatgatttcaatgatgtttttgcacttcctgactatatccagaagatgatggataacaagtggctgggttcaaaaacagagcagggattctataaaaaagtgaaaaatgcagaaggaaaatctgaaattcatggattaaaccttgatactttagaatatgaactacaaggaaaatcatcattccctaccctggaattaacaaaatctattgataagccgatagatagattcaaagtgctgatcggtggtaaagataaagccggagaattgtacagaaaatctctgggagcattattcgcttatgtctcgcacaaagttcctgaaatctctgacgaagtttataaaatcgatgatgccatgagagccggtttcggatgggaaaacgggccgttcgaaatctgggatgccgtaggtgttcagaaaggtattgaactggcaaaagatgcaggctatgaagtttcggattgggtaaaaaatgtagaaactttctataaagttaatgatgaaggacaaagtatttatgttgataaaaactcaggagaatacaataaaattcctggtcaggatgctttcatcattttagataatatcagaaaaaataaaacactttggagcaattcaggtgcggctattgaagatttgggagacggaattatcaattttgagatccgttcaaaaatgaactctcttggaggcgaagttcttgacggattaaacagagccattgatttagcagaaaaagaatacgacggattggtcatcggaaaccagggagcaaacttctctgtaggagccaaccttgccatgatccttatgatggctatcgaacaggattgggatgacctgaatatggcgatcgcttatttccagaagtccatgatgagagttcgctactcttctattcctgtggtagttgctcctcacggaatgactttaggtggaggctgtgaaatgacaatgcatgcagacagagtggttgcagccgcagaaacatatatcggactggtagaaaccggagttggggtaatccctggcggtggtggtactaaagaactgactttaagaacctccagagaattccacaacgatgatgttaaaaataacagacttcgtgacgctttcatgaacatcgctatgggtaaagtggctacttcagcctatgaagcttatgatatgggaatccttgagaaaggaaaagacatcgtttccgtaagcaaaaacagacagattgctgaagctaaaaaagtagcgaaactgttagcagaacaaggctatacccaaccaattgaacagaaagtgaaagttttaggtaaagatgcattaggaatgttctatgtaggaacagatcagatgttaaccggaaactatatttctgaacacgataagaaaattgcagataagctagccaacgtaatggtaggtggaaacctgtctgaacctacagttgttacagaacaatatctgctgaaccttgaaagagaaacattccttcagctttgtggagaaagaaaaactctggaaagaattcagtacatgttacagaatggaaaaccgttgagaaactagatttttttgtaaaatgtaaaaagtattaatgtattcacgatgcataattttagagatttagaagtttggtcaaaatcaatgaaactttgtaaaatattttatctggcttcaaacggttttccaaaagatgaaatgttcggattaacttcccagtcaagaagaagtttatattcaattccttctaatatcgctgagggtgcgggcagagatacagatgctcagttttcacatttcttaaatatagcattaggctcttcatttgaatttgaaacccagatattaattgcaaatgatttaggtttctttaaaaatgatgattttaatattattaattcagaaatcaaacatatacaaaatatgttagcaaagttgaagcagaaatttaatacttaaacattttaatcataaatacattttacataaatactttaatacaaaaaaaaaatgaaaacagcatacatagtaaaaggattcagaacagcagtaggaaaagcgccaaaaggctctctgcgttttacacgtcctgatgtgatggcagctaccgttattgaaaaattaatggctgagcttacgcaattagataaaaacagaattgatgaccttatcgtaggaaatgcaatgcctgaagctgaacaagggctgaacgttgcacgtctgatttctctgatgggattaaataccgataaagttccgggagttaccgtaaacagatactgtgcttcaggaagtgaggcgattgccattgcttctgcaaaaattcaggctggcatggcggattgtatcatcgcgggtggtaccgaatcaatgtcatatattccaatgggaggttataagcctgtccctgaaacggatatcgcaaaaacaaaccctgactattactggggaatgggttacactgcagaagaagtggcgaaacaatataagattacaagagaagaacaggaccagtttgcttttgaatctcacatgaaagctttaaaagcgaatcaggaaggcagatttgccaaccagatcgtttcgattcctgtagaatataactttcttgatgaaaatcagaaactacaaactaaaaagtttgatttttcagttgatgaaggtccaagagcagatacttctttagctggcttggcaaaattaagaccagtatttgccaacggaggaagcgtaactgcaggaaactcttctcagatgagtgacggagcagctttcgtaatggtaatgagtgaggaaatggtaaaagaattaggattagagcctgaagcaagattagtagcttacgctgcagccggacttgagccaagaatcatgggaatggggcctatctacgctatcccaaaagcgttgaaacaagcaggtcttgaattaaaagatatcgatttgatcgagcttaacgaagctttcgcctctcagtcagtggctatcaagaaagaattaggtttaaatcctgacattttaaacgtaaacggaggagctatcgcccttggtcacccgcttggatgtacaggaacaaagcttaccgttcagcttcttgatgaaatgagaaagcgtggcaacaaatacggaatggtttctatgtgcgtaggaaccggacagggagcagcttctatttttgaactcctttaatagacaaatagagaatagacggatagataatagacttaaagacaccaaaaatgtatgaatgattttaagaggcacaattttaagaagcttaaaatttggcaaatgagtatggaattatcaagattaactttagatcttacagatacttttccgacttatgaaaagtatggtttgaaaaatcaaatggacagatgtgcaatttcaattccatcaaatatagctgaaggttcaagcaggacaaataagtcttttagtcattttttagatatttctttaggttcttcatttgaattgcaaacacaaatattgttagcaaatcatagaaaatatttatctgatgaaaaaactgaaatctttgaaattaagattgaagaatttcaaaaagcagcaatggtatttcagaatactttaaacaaagactaagaaaaagaataagaggtaatagaacgaaagaaaatagacaaggatgaaagtctatcatctatttgtctattatctaaaggtctcaaaaattaaataacaaaataatatatggctacattaaaaggcggggaattcctgatcaaacaaattcctgcaaacgaaattttcagtattgaagaactgaatgaggagcaaaagatgcttcgtgattcggcaaaagaattcatagacagagaggtagttcctcaaaaagagcgtttcgaaaagaaagattatgcatttacagaagaaacgatgcgtaaactgggagaaatgggaatgttggggattgctgttcctgaagagtacggaggtcttggaatgggatttgtgactacaatgcttgcctgcgattatctttccggaacaacgggttctttggcaacagcttacggagcacataccggaatcggaactcttcctatcgttctttacggaaccgaagagcaaaagaaaaaatatcttccggatttagcaacaggaacaaaattcggagcttactgtctgacagagccggatgcaggttctgatgccaactcaggaaaaacaagagcaaaactttccgaagacggaaaacattatatcatcaatggacagaaaatgtggatctctaatgcaggatttgcagatacatttacattattcgctaaaattgatgatgataaaaatatcacaggatttgtgatcaacaaatctgagcttgaaaaccctgaaagtttaactttcggtgaagaagagcataaattgggtatccgtgcttcatctacacgccaggtgttcttcaatgacatgaagatccctgtagaaaatcttttaggagaaagaaacaatggttttaaaatcgctttaaatgcattgaacgtaggccgtatcaagttagcagcagcgtgtcttgatgcacagagaagaatcttaaaccactctatccagtattctaacgaaagaaagcagtttggtgtatccatttccacattcggggctatcagaaagaaaattgctgaaatggcaaccggagtgtttgtaagtgaggctggttcttacagagctgctaaaaatattcaggataaaattgatgagttggtagcagccggattaagccaccaggaagcagaattaaaaggcgttgaagaattcgctgtagaatgttcaatcctgaaggtatttgtgtctgaccttgctcagcatactgcagatgaaggaattcaggtatacggagggatgggattctctgaagatacacctatggaagcagcatggagagactcaagaatttcaaggatttatgaagggacaaacgaaatcaacagattattagctgtagggatgcttattaagagagcaatgaaaggtgaattagacctgttgtctcctgcaatggccatcagcaaagaattgatgggtattccttcatttgaagttcctgattactcagaattcatgagtgaggaaaaagcaattatcgcaaatcttaagaaagtattcttaatggtttccggagctgctcttcagaaatatatgatggatattgagaaacaacagcatttattattgaatgcctctgaaatcctgaaccagatctatatggcagaatctgcagtgttaagagcagagaaacatttctctcctgattctgtagaagcagctatggctcagctgaacctttacaaagctgttgagaagattatcactgctgctaaagaaggaattgtgtctttcgccgaaggagacgagcagagaatgatgctttcaggattaagaagattcacgaagtataccaaccatccgaatgtagtagctttaaccgaaaaaattgctgctcattatattgaaaaaggatcttattagtctttaataacataaatttgattcagcgtcccaaaattgggacgctttttcttttcacccctatttattatgattatcattggatttattaacaatcattaaatacattcaaaaaaaatcattatttttattctaaattaaataacacatgaaaatcttattatttccgatattccttatttcagtggctttctcagcacaaaaaaaagaagatgtaatccctgttcctaaagttgatacgacaaaaatcgtttctaaaagaaaattccccgggtattttgctgtaaaacctgagcttcctcaaaaagaactttataaaatattagcagttaaacctaaagatactaccctttatctcgctttaaaagaaccagcaaaagattactctcaatataaaattctgaatgccattacaagggaaaaactcgatataaatccgaaaaaaacaacacaatcgaaataaaacaacacaaactaaaaactattatcatgggaaaatttattatctctaaacgatcaaacggtgactttcaattcaaccttaaagcaggaaacggacaggttattttaaccagccagggatacagcaccaaaccttcatgcgaaaacggaattacatcggtaaaaaccaacgctcaggaagattcaaaatttgaaagaaacacagccaatgatggcagatgttattttaatctgaaagcaggaaacggacagatcataggaaccagccagatgtatgaatctgataatggtatggaaaacggaatagaatctgtaaaaaacaacgctccgcatgctcacatagaggatgaaactacgatgtaaaaatcatctgaaatattatggataaaaatgccttagtttttaaggcattttttatttttgtactctatttttcattaaaaatgacaaaagaagaattactgaataaagcaatcaaaatcgccgataaggctcataaaggacaaaccgataaataccatgctccatacattgcccatgtaatgcgtgtgatgaactatggtaagacactggatgaaaaaatcgtaggggtactgcatgatgtggtagaagaccacccacaggaattcagtctggattatttgagatcggaagggtttccagaatatattatcttcgccattagctgccttacaaagctggatccagaagaagattatgacgaatttatcaaaagaacagaaagatctctcctttccgttgccgtaaaactgaatgaccttcgtgacaatatggaccttagaagagtaaaccgagagcttactcctaaggatatcaaaagattcaataaatatctgaaagcctatcgttatctgatagagaaatattaatctgctcctgggaaatcgtaagttttcgtgtggtggtctgttccgtcaatgttaatgtttaatgccaggtaaataaaatgtaaatttttatttccttttgcttcgaattcacgctgccacagatatccgcttacaacaccaaaataatcatcgatctgatagccgaaaccgccatagactctgtttctggcgaaagtaggcttcatcggagagacaaagaaaacttcgtcataagcgttggcaaaaacagttcctttctttatggttttggcatttagagggacactgatattcaggcgatacctgtaacgcattctctgagatgtctgatctgttttaggctcatagaaccagcttttttcagcacggagtcggttttcaaactttacgatgccttttttaagatcaataacatcctgaagccatactcggaattcttccctgcttaaactatgatccttataattaacataccttccaagtcctacgaaaggtttgtgatttttagtaagattatatcctactcctccttttatttcataataatcagggtaagtataatcttcattaccacgtagctgtccttctgcatacaggaaaaatttaggatgaaacttataggtcagagttactgcgttgaagctggaaatatgttcctgtgctttaaagaaagaaattccaagtagtaagcctaagcctataaaacgtttcataaaaaatttttgcaaatgtaaattttttaacaatttgttaatattaactttaattaatattgaattaacagctacttaatattaattgtataagaaaatccgatgtggaaccatctttgaggcattgccactccaaatgcttcggtataatttgtattggtaagattgttaaccaacacataaacagagtaatctttaccggaaaaactcagtttttcatctacaagattataagttcccagatttaccctttcattataacggtaaacaagctcattggtaaagtttttaaggaatctgacctctagcttagaaataaactgatgcttcagattatccagaatataccttgaaaccaggccttctttttcttcatatttactgtcgatatacgtatatccaaccgtatatttcagccagtctaccggtctgtggctccactctgcttctattcctttggttttaatatctcctacgttctgggcaaaccatactttatcactgatgtcatttttcacccagtcaatagaattgctggaatttcttagaaatccactgattttagctaaaatcctgttgttttgatattgatagcctacctcagaagaaaccgcattttcaggctgcaaatcagggtttccctgttctgttctgctgacataatacagttcggtaaaggttggtatacgatgtactttcgcaatatttccgtagattttattattggcattaaagatatatcctacatccagccccggataaaagaaattaccttccttggagtaattggcccacgaaatccccggactgatattcagttttttgtcaagtaatgaaaaatgatgttcaaagaaaacctgggaaacaaaacggtttctgtctcctaaattactgcttgccagaaactcttttctaagctcaactccaactccggttgttcccagtccccattggtagctggaattcacttctccacctacgttatttccgatatgcatatttctgtaaaagtcaggatcccatctgttgtaaagatacatatcctgccctcttctccaatacacatttgaattaagtttaagctttccgaaagtctgctggtgggccacacttacaatagaagcctgtgtttcctcatactgttttgtagcactactcgaagcataaaaaccattggctccgaatttcttttctgaaaaaccggcctgtactcttacatctccgtttttaatattcaactttccctggtaaaatacattcctgatttcgtaatccgtattgaacatatagccttctgaagaagcagaattggcctgaatagcattggtaaacttctcatttcccacctgcgcattaaatccaagaccatacgaaccgtaatctcctccttctgcactgatcttcactttttttcccggagtagttttcgtaatgatgttaataactccggcataagcattctgcccgaaacgtcttgctgccgggccttttatcacttctattttctctacatcatccaggtctaccggaatattcatattattatggccggtctgggaatcattcatcctgatcccatttaacaacagaagaacctgttcaaaagagcttccacggaaaccgatatcactctgcacaccattggctcctctcctcctgatatccattcccggcacctgctgaagaatttcatcaatacttttggcaggagaatttacgatatcttctctggtgataacactaatgttctggttggcgcttttataaggtgtagagatgaattttccctgaaattcaatgctttcaatatctgttgtcttttcctgtgcattcacccaaagtaaagatcccagaaaaaaagcacttcctatctttttgatcataatcgtttccgtagttttttaacaggtccaaaagtaagagagttcaccaagacaggcaaatgatagttgtcataaaaaaagatgcaacatcatgctgcatctgtgtgagggagtaatttctatctttttctcattaaatgtgtaactagatctctgaataattttctcatttctatattacatatttacgggtacaattttaaataattttataatataaaacaatagttaaacaaaaaaaatacaacgtattaaaaaaaattaagtaaaataccttaaattaaacattaaaatagaagcaagtccacaaaacatactttttcttgttgtttattgaaaagaatatttcgattttagtactctaatttaacattcattataacaatttttaacaataagatatacatcagattttcgctaaaatttcgtaattttgttggtcttaattttacgatgaaaacattctttttcaactggatattgaaacagcaatcttaacaaaatgctgctgtgaaacgacagaagaattcaggaatatattcaatgtttcaattgatgacagccccggtatatgctgaggcaatacaccattattctgacagccttattgctgtacagatactttagaataaacaaaatatggctaacacaacagaaatagacataaaaaaacagatcttcgttaagaatgcacatcttaacaatctgaaacatatagacgtcctgatcccgaaaaacaaactgatcgttattaccggggtttcaggaagcggtaaatcatctttggcttttgataccatttatgcagaaggacagagaagatatgttgaaagtttaagttcttatgcccgtcagtttttggggaaattagaaaaaccaaaagtagacgacatcaaagggctggcaccatctattgcaattcagcagaaagtaatatcgtccaatcctcgttctactgtaggaacttctacagagatctatgattatatgaagcttttatttgcaaggatcggaaaaactttttctcccgtttccggagaagaagtaaaaaaagattccgtttcggatgtggtagattttattaaagcatccaaaaaagacagttcttttctattgacagcgccactggaatatgataccgacaattttaaggagactttaaatgttttaaaactggctggtttcacaagacttgaaatcaatggaaatgtagcaggtattgaagatctggaaagttttggttttaccccggaaaaaggcatgaccattaatcttgtgattgaccgtttctcatatgaagaagatgaaagctttttacaaaggcttgcagattccattcagatggcattttatgaagggcgtggctattgcgcattgaagaacacagataccggaaaggtgaaagagttttccaataagttcgagctggacggaatggaattccttgaacccaatgtccactttttcagttttaataatccttacggagcctgtccggcatgtgagggatacggaaaggtaatcggaattgatgaagatcttgttgttcctaacaaaacactgtccatttacgaagatgctgtggtatgctggagaggagaaaccatgagtgaatggaaaaaggatttcatcaaaaaagcgggtgacttccctattcacaaaccttatcaccagttaacaaaagaacagaaaaacttcctttggaaaggtgacggaaggagtaatttcccatgcatcaataatttcttcaaaatgcttgaagaaaacctctataaaatccagtacagggtaatgctttcccgctacagaggaaaaaccctttgtccgacgtgtgaaggattgagacttcgtgaagaaacaagctgggtaaaagtagacggacataatatccagtcgatgatcgaacttcctctggatgaactcgctccgctaatcaatgggctcaagctttcagaacatgataaagaggttgcaaaacgattattgtatgaaattacaacccgcctggaatttttattaaaggtaggattagggtatttgaccttaaacaggacttccaatacgctttcaggaggagagagtcagagaatcaacctcgcaacaagcttaggaagttctttggttggttctatttatattctggatgaaccttctatcggactgcattccaaagacactgaaaacctcatcgaagtattgaaaaaccttcgtgaccttggaaatactgttattgtagtagaacatgatgaagatgtgatgagggctgcagattacattattgatattggtccggaggccggttatcttggcggagagctggtattttccggagattataaagacctgaaaaaagccaacactcttacttcagaataccttacaggaagactggaaattgaagtcccgcaaaaacgcagaaaagcaaaagaatggattcacattaaaggggcccgtcagaataaccttaaaaatattgatgtagatgttcctttggaaaatcttgttgtaatctcgggagtttcaggaagcggaaaatctactttgatgaaagagattcttaccaatgatattcagattcagctgggaatgggtggtaaaaaaggagactacgattctgtagaattcccgaaaaaactgattaaaaacatcgaattgatagaccagaatccgattggaaaatcatcccgttcaaacccggtaacatatctgaaagcttatgatgatatcagagatctttttgctaaacagaaagtagccaaaatgatgggttacaaacctaaacatttctctttcaacgtagatggcggaagatgtgacgaatgtaagggagaaggcgtgatcaacgtttccatgcagtttatggcagatatcgaacttgaatgtgaggtttgtaagggaacacgattcaaaaatgagattctcgaagtgaagtttgatgagaaaaatatctcagatatccttcatatgaccgtagatgaagcgttggaattctttaaagataacaatgaagaaaaaatcgtaacgaagctgaaacctcttcaggaagtaggtttaggttatctccaattgggacaaagctcttctaccctttccggaggtgaggctcagcgtgtgaagctggcttcgttccttgtaaaaggagtaacaacagacaaaacgttattcatctttgatgagccttctacaggtcttcatttccatgatattcaaaagttattgaaatcattacaggcactgatcgatcttggacactcagtgattgttattgagcatcaacctgatatcattaaatgtgccgactatattattgacatcggccctgaagcaggaaagcatggtggagaagttgttttcgcaggaacccctgaagatcttactaaaaacaaaaaatcctacactgcaaaatatatcaaagaaaaacttgaacaataaatacaatcggctgtttttgaaacagccgattttttattcagattctttatctttattaaccattacaaaattatttttatgccctggaatcccgaactatacgaccagtacaaagatgtacgttacaaacctttttacgatttagccgcattaatcaagcctgaaaacaatattaaagcgattgacttaggctgtggcaccggagaacaaacttctattctgacagaaaaactgacaggttctgtatttttaggaattgattcatcagcagaaatgcttgaaaaatcgaagaagtacgaaagtgaaaatctgcattttaagctccagaccattgaagaagcagcacaatctggtcagaagtgggatcttgttttcagtaatgccgctttgcagtgggtggatgatcatgaaaatttatttcctaaaatcattgaactcttatcaccagaaggtcagctagccatccagatgcctgtccagaatgaaaatatactgaatcagatcctggcgcagatggctgatgaagaaccttatgcatcttatctgaatcatttcaaacgggattccccggtactttccatggatgattatgcacagatattatttgacaacggaatagagaatatagaaatattccagaaggtttatcctattattgcagatgatcacgaagctttatatgcctttatttcaggaactgcattattgccttatcttgaacgtctggaaggagaacagaaagaaactttcatcatcgaatttaaatcccgtatcgcacaaagatttacaaaatatcctgccatttatgcatttaagcgtattctgatgtacggacgtaagaaataaaaaatcttattaaataagctgtcacaattttgtgacagcttattttttagcattctttaatcttcagattgaggttgtttaaacttttatattcattattttaaccgcaaaagttttaaatatttcaatttttaagaaccaaaccttaggtgtacttttctgcggtatcattttaaacgtacttaaatgaacttaagtgttttaaaatgaagccttttgtaacctttgtggtttggtaaagtttaaacaactttattatataaaaacggactcttccgtatataatctgaattttcaatctgagaacccaaaaactcagcaagatccgcagcactgatattctcacccttacaatctgtcaggtttgcttcagttgtgaaattttcatctgtaagattgattaatggtaacctgaccaaagtccagtccagattacttttcagaaggagttcatactctttttgcttatctgctgttgtttcaggatagttttgatacatccattctgtagccatttttactctttcatttttttgatcggataaagtatttacgctcaatccggtagtgacaatataccggcttattccatgtgagttcattgctttaataatatttccggcagcatcactgaagatagacttctctccttttggctggcctaaagtacttattacaagatcagtttccatgatcagtttatggatcgctgcttcatccctcgcatctccttttaccgtttcaattaaaggattctgaaggataaagttttcggggtgtctcagtaaaagcttaagagaatgtcctttttcaagaaggtgttttaccagatattgtccggattttcctgttccgccgataacggcaattttatatgttttcataatgatttttttaatattaaacatcaataatcaaaagcagattaaccacgaatgaccatcgataaagcaaataacatattgtttttgctttgataatgatataataaaggtattgggttcagaagtttgaacctaaaatctcagggatcagaatacaccctgaacaagagtaatatgtattacgagattttaatgaattaaagttacactttttaccattaaaaaatcaaaaaatttatgattttaacaacactttttaaaagataaagtttataactttgataacaaccttactatcaatacattcacccaaaccaaatacaataagaatatggaaccatttactgttaacattcctgaatcggtaataaccgacctgaaaacccgtttacaaaatacgcgatggcctgacgagcttgaaaatgccggctggcattacggaaccaacgaaacctatctgaaagaacttattcaatactggatcaatgattatgactggcggataaatgaactgcagttgaatcaacatcctcagtatacaacacgtatagacggaattctgattcattttcaatacatcaggggaaaaggtcccaatcccaaaccgttaatccttacccatggctggccggatagttactaccgtttccataagatcattccattgcttacagaaggtgagcaaagctttgatttagttattccttccctgccgggatttggattttctgataaaacagcagtcagcagtgaaaaggtagcagatctgtggaaaaaactgatgactgaagtacttggatataaaaaattctgtgctgccggaggagatataggtatgggagttgtaaaatcactgacttcaaaatatcctgaagtcatggaagctgtccatcttacagatgtaggttatccaaccggtcaggaggatccggcaacaatgagtgaagaagaaaagaaatttgcacagtttgtccagcactggtggtatagtgaaggtgcttatgccatggtacagtctaccaaacctcagacgcttgcgtacggtttgaatgactctcccgcagggcttgcaggctggatcataagttttgtgaacgccggcactcctccggaactcatcgaaactgcatttggcggaaaagacgaaatgcttaccaatattatgatttactgggtaacacaaaccataggttcctctgcgagaatgtataaagaagatgcagctgctttatggaacggaactcaggttcatcaaaaaagtaatgttcccgcaggtgtgcttgtatttccccgtgaagctcagtttccaaaagaatgggcagaacggtttgtaaatgtgaccagctttaaaaaaatggatgaaggaggacattttgccgcactggaattacctcatgtatttgcagatgagttaagatcattcttttattctgtcacataaaaatcaaaccatgaaatatcctgtatccattattcttacaattcctttgttggtcacgagctgttctgttcaaaaaaagaagactgaacacaaggattacaaggtacaactggataccttaaccctgtttgaccaaagcagacaccgaaagattcctgttgccatttatcaccctgaaaacaataaaaagattcccaaccaacaggtgattattttcaatcatggatatggccttaataaaggcggagattattttgtttattcttatttaacggaaatgctcgcttcaaagggttatttcacggtaagtattcagcatgaacttgcgacagacaatttaattcctacggaaggaattccgcagatcgtgagaagacccttctggcaaagtggttcggataatattctgtttgtgattaacgaacttaaaaaaacaaaccctgaccttgatttccggcatcttaccttaataggacattccaatggcggtgatatggcagcactgttcagcaatcagcatcctaatatggtgtataagctaatcacaatggataaccggagaatgtttctgccgagaacttccattccaaaaatttatactttacgctccaatgattaccctgcggatcagggtgtattgcctgatgaaggagaacagaaaaaataccatatcacagtgcagcctactctgatcaatcatgatcatatggataataagggaagtgatgaagaaaagcggatcttaaacaattggatcttacaatatctttcagaacagtagtttctgaagatcaccacaagttatccacaaaaaaatgtggataacttgtgaattttaacatttaattcatgtttcgtattgaaattatcactacatttactatgtaataaacatcgaagtggaaactttatttgcttttcttactactattgaaattgcaattaaatttgaaataaaaatttaagcacagcattgtcggctgtgctttttattgttgtctaattaaaaaaatgagatgtattatctactggatctgcctctaaagggcagattcttttatctgtataccttctacaataaagttttttaaaattgatgactctcaaaagcacaataaaacattctcaaacttctctgtaacctgtggttatcttcctcgtttgtattatattaaataatttgtaattttattacccaaaccaggcctcatagttcaatggatagaatagaagtttcctaaactttagatccaggttcgattcctggtggggctacaaaaatattcttaatcacaagtggtaaaaccttcaaataactcataaatcaggcttttaaaacttactttagccagcttgaagttatttgatattattttttctcggaagtctgatctcatgatcctgcggatacggtgcgcgaaaagtcatgctaacgtcttcttttattttttcctgagtctcatatcgtttatcttcatcatgcgaatatctgggatcgggtatgaatggcatttttgccatttttgtgacagtaatggtaggaaaatgaaaatcaacctccacggttcccagaagcagatagcatcccccaccctgaaatgggtatttttccaggcagtccggaaagtgtgccgtatcaaaatagtttccttcaacatctatccaggtcccaaaaaacatggttcctcttttagtaggcacgtgtttccttgcgatcagatatgccaacatcttaacctcgcttttatgatattttatcagatcattagccattatgtgccctttatattttgtctgcaaaaggtcaaaaggagtacaggaaaccgggaaactcagtatttcaatttcatcaaaagcgtcttcaaagacatttcgtttcagttccggaagcttaaaatcctttaccggtgtatcaaataatgtctgcacccggtgctctggtttaaattcacccaataatactctggcttttaacagcagttcatttttgggtattcccgtaaatctaaaggctccgataaatattaagatctggagcgtttcaatacctacaggaattcttttaatgaaatcttccattgacaaataatccccagatttccttctttcttccggaatcaattgggctattttagattcaactttttccagaagcattaatcccaaataaatattatcaccataaatcgttgtttcatattcacttttattaacacatggattaagtatttttcccccggacattttagcctcatgtacatatacttcagtcctgtaaaagcctcccatattattgatggctgaaaccatgaactccaaaggataataaactttaagataaagactttggtagctttcaaccgcatatgatgcagaatgcgctttacagaaagaatatccggcaaaagattctatctgcctgtaaacttccctgcttaattcttcagaatggcccagttctctacatgattcgaagaaatgtttttttactttctgtaagtcttccagtgatctgtacttaccactcatagctcttctgagaatgtcaccatctgcagcagacaatcctccgaaatgtaaagcaatttttattacatcttcctggtaaaccattatcccatatgtttctcccagttcctcttcaaatactttatgaaaatactcaaattgattcggattgttatgcctgaaaatatattctctcatcattccggattgcgccactccaggacgtataattgatgatgccgctaccagtactttgtaattatcacacttcagtcttctcagcagtccccgcattgccggtgactcaatatagaagcagccaatggtccggccttggcttaaaaactcattacagatcttttcatcctttgaaagtgtagtatccttaatatctactttaataccccgtttttcttcaatgagcctaactgtgtccttaatggtaccgagcccacgctgtgaaagaatatcaaacttttcaaatccaagttcttctgccatgtacatatcccattgtacaatcggaaatcctttaggaggcatttccagtgcggtgaagtttgttaatggttcttcagaaattaaaataccacaagcgtgcatacttcgctggttgggaaatttctccagcagttttccgtatatttgaactttctgtacgatttcgtcactgaaaacgctttcaggatttttactcagttcgtccagctcttctttcggtaatccgaacgcttttccaacttcccgtataatcgaacggtatttgaactcaacatttgtcccgcagaatgctacgtagtcttttccatatcggttaaaaatgtaatccaatataatatcccgtttctgccagctccaatcaatatcaaaatctggcggacttttcctgtttaaattaagaaacctctcaaaatataaatcgagttctaatgggcatatgtccgtaattccaatacaataggctacgatactgttagctccactaccacggccaacatgcataaatcccatactattactgtattggataatatcccaggttataagaaagtaaccgctgaaatcaagttcatcgatgacctttaattctttttcaacccgtaacttagcctgctcatttttccttccatatcttttttctaaaccggtataggctaaacgggttaacagttttaaatcatctgcttttgtaccggtgtaatgctttttatttcgaggggtagaaaacgcaaaatcaaagctacattgagacagaagccttttagtattttcaattatttgaggatagtacttaaattcatccagtaaagattgtggagatttaaaatactctgatttatgacagatttcattctctggcaatagcgacaacaaagtattattgtcaatggcccttaagatgcgatgtaaattgtattctttttttgttccaaaagttaccggctgcaggattaccatttttgaaatgagattcctgtattctgaccggatcaaaagatttaattcctcctgtcttattcctatatattcattttcctttagcccttccggattattttgtaaagaataaatgataaagttatgatccagatttggtctttccggtaactcggtgccatcacagttatattcagtcagcatcttgtttacttctcctaaaccggcaaattttttagcaatggcaatatataaaagcttactcccttttctgacttctatgcctgctactggtttaattccttgtgattcacatttctttttgaattcatacaccccggtaattgtgttgatatctgtaagtacaagctcattgattcccaatgctgatgcttgagaaacaaggtcatctatagatagtgttccatatcttaaactatgatatgaatgacaattcaaatacatacgtgagcattaatgtgtaaaatcaaacccaactgctctaccgacagcagcacttccaaatctattcttaatattgtccatagcctggtaaaggctcatcagttctgcagtatcttcaaataaattcatttgatagctgccatgtactaaatctgtgaaccttaatcctaccagcctcaaccgcatacgtcttgaataaactttatcaaataattccaaggcaaccctggaaagcgtgtgatctgcagaagtataagcaacacgacattgcttcgtttccgtatcaaaattggcatatctgatcttaataaccactgtagacgtcaaccatttttcttgacgcagttggtgagccagctgctcagccattcctgaaatcaaccttttcacttcattaatatccgtagtatcactgctgaatgttctttcttttgaaatagattttctttctgaatatggcactacaggcgtttcatcaattccgtttgctttcctccatagatcagtgccatttttaccaatcatttgctgcagaacttcaacaggtatttcagaaagcgtaccgatagtccttattcccactctggaaagaagtctaaaagtagcatcgccaaccatcggcattttctttatgggaagcgggtttaaaaatgaatgaactccaatggaaggtatttcacggtgtccatgcggtttagattctccggttcctattttgctgacggtcttatttatagaaagggcatagctgatcggaagaccggtttccttttcaattgttgcccccagttcatttgtccatttataagcgccgaaaaacttgtccattccggttaagtctaagtagaattcatcgatggatgatttctccataaccggagctttctcttcgataatttctgttacagtatgtgacattttagagtacaattccatatctcctttgactactttagcttgtggacaaagcctcaaagccatacgcattggcatggcagaacgcacaccaaatttccgggcttcgtaggaacatgaagacacaactcccctatccccaccacctattatcaggggaattccgttgagttcagagttcacaagtctctcgcaggatacaaaaaaagtatccaggtccatatgtacaattgaccgttccattttacaaaattagatatatttttaatcaattatgataatatatattgatatattttgtatcaattttattataacaaaacaaaaccctttatacgtcagaacttgacgcaataaaaaagttatccacaaaaagtaatataataaaaaaacctcctgggaaattaggaggttgaatacatatcatccgatattgaagtaatcgaacacttaaatatataaaatatttcattatttagtgatgcattaagaaatttagcacaatccctttattcatagtacttacagacaaaaacacctctcagaaagagaggcgtatacagactgattagttcataaataaaccacaaacgagtcaaaaataaaaaaacttcatcaaaaaatgaagtttaaagtgtgtgattaagtatagataaatgatgtggtgttgtgtaggttgtatttttaaaaacctgcattaacactaacaatacacatgccatcatcatcactgtttaatgaaaagttgatttttgtggtatcttttttttaaaaagccgacaaccgaacaagtatattaataatccaacttgttaacattttatcttaaaatatcaaaaaaaactcctgcaggaggtcattctgtaaatcagtagaaacttgtattatacaaacataaaaatccccagccatagccagggacattaaaaaaactttctgtacttgttgttatttaaaactcccgtaaatatacggactggctgtagtcataactctacgggaaaccgtaattgagtatattaattatttgtaattagtataaaataaaatcttccaaatctattcttactattgtccatagcctggtaaaggctcatcagttctgcagtatcttcaaataaattcatttgatagcttctgtgtactcaatctgtgaaccttactcctaccagcctcaactgcatacgtcctgaataaattttatcaaatcattctaaggcaatcctgaaaaagctatccacaaaaaaatccccggagaaatccggggataaaactaataaccatgaactcaaaaaaatatgagttgtatcttaatatacgatgaattatagaattcagatttaaaaatcaaataaaaacctcccgggcaaacaggaggtatgaaaacttatgttaaaaattttattaataattcaaaattaataattctctattaaatgatttatgatcatgatcataaaaaacttctgccagcaattattcaccttctttaaccaaaactactcaaaacaaagaaaaattgtactacagacactgatctattaaaaatccacaaaaaaacctcccaacacatcaggaggtaaaaaaatgtctcttttcaaacaattttaattatcgtttcaaatataatagttccgtgtttttacaaatatgattataatcataactctatgggaaatcgtaaggattgagtagccgaatcttttctgatgattattttttctgactttaagattagtttaccaatatttttttaattgtatacagaacaaaaaacctcccgaatcactgggaggtcatactgtaatttgtcagaaatatgaaattttcaatgggccaaatttagtaagcagttatatcataggtatatgatttcaatcataagcccatctatttctcataccatcattttgctgttttgtcattatcgtcaataatggagatttatatttaagctcttgctgtaattttaatttccactttctggcccgaaagagccaattcagtcactccaacaatagtgctggcaacaatacaggattcaccatagaattcttttcccaaagtctgccggcttgcaaacccctcccgcatatccgttacgtagatcacttcctccgtgatatggctggcatttaacccatattcacttagtaatttacctatattctgatacgtctgcctgaattgattttccattccctctgcaagattcccttccatatcatgtcccagttgtcctgagatccagaccaaatcaccgcttttcacagattgtacatatccgtataccttttcccaaggcatatcaaaggttttgaattctttagtattcataatttattttattattaccatactttatattcaacaaatacgcacaaaatttcaagtaactaattatcagaaatttacaaaatatatcgttttgtaaataaatacgaaataccgtagttttatatgcacattatataatatccggagttaagtattcatatcagataattggccagggcccggtaaaatttttattgattacattatgctaatgccttcttgtactcagataaggctctttcacgggcaaaagtatgttctactatgggtgaaggatattcaggggtattccattcaggaagccattttttaatatactgcaggtctttatcaaatttttcagtctgagttgtcggattaaaaaccctgaaataaggagcggcatcacaaccgcttcctgccgcccactgccagtttccgttattggctgcaaggtcataatcattcagctttgaagcaaaatatgcttcgccccacctccagtctatcagcagatgtttacataaaaaacttgccacaatcatcctcacgcggttatgcatatatcctgtctggttaagctctctcatacccgcatctactatgggatatcctgttgttcctttgcaccagtgcctgaattctttttcgttattccgccattgaatatcatcatacttttctttaaaagactgatgaacaacccgcggaaaatgatataaaatctgcataaagaactcacgccagatcagttccgaaagccagacggcattatgcttcaatgcaaaagccatacattttctgatgctgatggttccaaaacgcaaagcaatccccagctgtgttgtatgttgtaatgccggaaaatcacggtattggtcataatcatcaataatggaagcgtccagaacaggctttgaaaatttaaaatctgtttttttgaaaccaatttcctttaacgtcaggatatcagagtattcctgcaaaaagaggtttttaaaatttaattcaacagcctgataatgttcaggctttaataactcccgccacttctttgcatagggtgtgtataccgtgtatggagtgccgtcttttttaacaatctggtctttatcaaaaattacctggtctttacaggctttaaaaggaattttcttttcagtaaaaaaataatagatttccttgtctctttcaatcgcctgcggctcataatcacggttacagaatacactttcaatatcatattcttcagacaattttctgaatatttctacaggtttgccatagtaggtattgagctttgaatggtatttttttaatgaaatattgatatccgtcaaagcctgatggatataatcaacccttcggtcttctttatcttccagttttccgagaatatcggtatcaaatataaaaacaggcattaccggagcatctgattgaagtgcatggtgaagtccgatattgtcttccagccttaaatcacgtctcagccagaacagggtgattttacttttcatgatttttaaaattcaaactacttcttttattcctttgtacggaatgttttttataacgaagataaagatactgattatcatataaaattttaaaccccgacataaataagctttatcattacccatttatttgacaatatccattaaaatttacgacctttatcggaattttaattgaaaaacctcacagcaatggaagaattcgaagtaccggtaacttataaaggacaagatctgcttttcaacggaaagcttgctactttctcttatgggtataaactgtatgtggatgttgatggaaccgaagttgttattgagcgtgacgatcacggtgacttaagagctcttcttccagatgccgcttcagaaaaaaatatagataaagggcttatagaagcgattgttgaagtttttaaaggactccaggttttatagaaacaagccaggaaataattcagcctctgaaaaaaatttcattgcaaggctaaaaaatctgattagctttattttcagaattaagtcactgtttacatttaatatactgtgatatgagaaaattaacttttctttttctaatggtacccattcatttgcttcatgcacagcaaagcaatgtaaaacaattcataattatcaggtaaagtgatgacatatttctctttaaacaaagtggctgaaaacgatataaagttaactttatattattttgaagggaaaatcctttgcaaagaacttagttattttaaatttttcctgtattttcccggagttactcccttatgttttttaaaaagtttggaaagatggctttcgtcactgaactggagttcataagcaatttcacttaatcgcacactgctgtatttcaaataggtctctaccagctttagtctatagtccagcagataatcctgataggaaattccggtctgctgtttaaaatattccccgaaatagttccctgaaattccaaaatgatcagcaataacctgaattcctgttttctcacgatcttttatatgctgctgaatataagcgatgattttcatgatggaaaatgctttccggttttcctgaaggtctgaagtttcactctgaaggatattccgggcaataagattcagaaggatcgacatgcaatttcggataataagatagtcatcagctttgtttttaaactcattggcaatctgcagaacaagggtttctgcaaactgttcatcatttttattcctgaaaacacagccagcccttgcgtgataattatggctgatgtattgcagtttatacaaattttcacagctctcaatacggtctgcttccaaccggattctgtcaataaactcaaccggacactgaatactaatcaggcgggatcctccactttgaaaacaatatatttcctgctgcgggataatgaaaagcttaccctgagagaaagtaatactacgttcatcatacctaagtgtacccctccctctgacaacataaacaaacgaaagaaaagtttttgttttaaacatgatctcttctccttttaattctatgtcttttacatcaatctcttcaagcggaagtcctttcatattataccctattttcctccaaaagtacaattttaacagaatatttagcgggtatttttgtataaaaaattatgaatgtaaatccaaaacggtggcaggcgctcaactttctgatcataggagcctttctttcgccactggattattttattgtcaatatggccctgccttctataaaaaaagcgttcagcgccagtgatcatgaactccagatgattattgccatttacggcctcacctatgcagcacttgtggtttgcggaggacggctgggtgatatttacagccgtaaaaaggtatttgtatggggattgtacacttttttgggttcatctctcgcctgcgcattttctcctgatattacatggctgattgctttcagaatgtttcagggaattggggcatcactgcttgccccccaggtattggcttctataaaagaccttttcaacagtcaggaacagcctaaggctgtaagtcttttcagttcagtattcgggcttgcttcagttatcggacaattgcttggcggagcgcttttaagcatgcattggagacatttttcatgggaaatggtatttcttgtgaatgtaccaatcacggttatctgtattattggcattcatttcacaatggataacagtaacaaaaaagaacaaacagggattgattttataggcgctttactattaattctcgctttgcttatgctcatctgccctcttattttcggacagaaatatgaatgggtctggtggattttcgggattcttttttccgggatcttattatttattttattcttaagatatgaaagaaaaaaacttcagaaagatcatccggtgctgatagatcctgcactgctacagcagaaaccttttgcattaagccttctgattattttcttttacaatttcaccgcgggtttatttatatgctatccttactatcttcagcaatttcttcatcaaaactcaatgcagaccggactcgctatagttccctatggcttggcttttttcctggcccctttagtgagttcccggataaaaatggcacctgtaaaaatgatcaatgcaggattgggattgttaataataggatttgtaggaagtgcagtagctttttattttcagcaaaaaccatcttttattacccatacgaccctgttcatagccggatttggtcatggtacggtgatgccgctcatgatgcggacagccatttctttggtttccagggacaaagccgggcaggcttcaggacttgtcagcataggaatccagattggaagtgttacaggaggagccattattggcactttatttttcaatctgataaaagtcacgggcttcacagaagcatttactgtcgctgtaggaatgattggcatttttcagtgtattggaatatgggcaggaaatagattaagaaagatcttggttcaacatacagattaattcaaaaaatacaatacatttaaatatgaacaatacagaaaaaattatcagggaaattatagaattccatcagaatattgagaaatggttccagggcaaaacagagaaccagcaagccctttacaggacgcttctgtccggattctcaccggaattcagaatgatcaatggaaatggtgatacagtcactttatctacgttatccgactggcttccaactgtattcggtaaatttccgcaacggaccattcaggtagaaaatatagaagtaaatcattctgaacatcatggacttgctacctacacggaaacccaggttacgggagaaactgttaccagaagagcatcatcagccgtttttctgctgaatgaagaaaaagccctttggcttcatcttatcgaacgatggatatagaatttcatagctgtaaaaattaaacagccctgattatccgcgataaacagggctgcatacctttaatggcagagttcttctgttattcagcccatggggagtgtaaaatgcagtcacagaaatttttccttttaaaattcggaatcatgaaagcacatacatccgcttttatatttccaaaggtggtttctgttttatgctcaaagccactgaaaaaagtgggaataattttctttttgaaatcattcctgggaaaaattttaataatctcttcccgatgctcgtcactcagattttcatacccttctcccatcacatcaagacctactcccgagtacattaaagctacttcattttctttgtgttctgcaattccgatagtggtatgaagggcaatggtatcccataccagctgaagtttatcctgagcaataccatgaccttttaagaaatctcttgcagcattggcaccatcaacttcaaatctgagatcaggactgctgtaatgggaaacaagcccaagatcatgaaatacagaggctacatacaacagctctgaatcatgagtcttattttcccgctttgcatttaatgaagagaataaaaaaacacgtaaggagtgattatagataaattctgtaccgtgctccaataaaagttctgtagcttctgtagcgattttactgtccggaattattattcctgcaacttctttcatacgatttactgacatagttttaaataattttatccaaaggtatcctgattactggtcccggggaatatcaatacatactgatgacatgtcagaatttcaaatctattttatactttggtatgaatgaaagtgttgcggtagtttgcaggagatatgtctgtattttttttaaaaaagtgactgaactgttcagaagtagcaaaattaagctgataagcaatctcttttaccgtatgtgaactgaattgtaatagtcttttggcttccgctataatctgcccgttaataatttcttttgcacttttatggctgcaacgcttacagagctcactaagtcttctcgatgtaatattcaatctgtcagcatagtcactgacggcatgaagggtatgaaaccggctactcagaagttccataaatttgcggtagataatataatcctgactatcaaaagttatctctttcacaattttcacattggccagcttgatcataataatctttaaataagctgccagtacatccatctgattggtataggaatctgctttgtattctgtaaataaaattttaaacaggttcaaaaattcctctttttcagtatgatctggttctaacctttgatttgccgaagcattattaaacagaacagctttacaattgctggcactggaaggtactttctcccaaaagcaatctccaaaagaaatatgatagcctcgtacagacaagtcgtttttaaatttgcagacctgtcccttggaaagcaaaaaaatttcctgtcctgatatctcaaaggaatgctgatctaccataaacatccctctgccactttctatcataataatatgatgataactgagccttacgaaatcccctgaatagagcagctgatcatgcaaccgttttacagaaaaagaatgctcaatagaaggttccgataatatttctgaagccagtttcatagaatgattttttgataaagataaaagttttgcccataatttgaactgcaagtttacccaactttatcaaaacagagcatgtcagaaaacctgtaacacatgccagaatttaccaaagttaattacttatttctgaatactttcatctgcccggccattacagcaagtaaaattccaaaacaggcaaaaagagcatatgaatacctgagatcaaaacttccggcaatatacccgataagaggcggtcctattaaaaatcctaaaaatgaaatactggagacaaaagacaatgctatactcggcgctaccgtactcacctttcctaccgtactgtaaacagagggaacactcagggaacttccaagcccgatgatcatgaaagcaataatacaaatccagagctccgggaagaaaacactaagaaaaagtcctccgctcatcagcaacccgcaacattgcagaacaatctttttcccatatttttcaataattctgtttccgataaacctacctaaagtcatcattaaaataaaactcgtataccccagtatgacaaggttttcaggtgctttaactatagtctgaaaataaactccactccagtcaaacatagcgccttcaatcgccatactcaggaagcctatgattccaagtccaaccagtgtaggatttacggatttaaagattgaacgggtctgcggttccgctttatggataatattggtcaggttctgtttgctgtataaccagagtattcctacaagcataaaagtaatcgtgaaatgatagaatgttcctacatgaagattaatcatcagtaaaccgagaactgctcccgtaagcccggcaaaacaccatgcgccatgataagatgaaagaagagttcttttggtaagagattctatttctattgcctgagtattgatggctatattgcacatgttcccggataccccgaagaagaacagaacaattgcaagagtccagtaggaaggtgataacccaatcagtaaaagaaaaaaaggatatagcaaaaaacatcttttaataatccagctgcttccgtatatactgatcagcttgccggccagaaccattgtggaaagctgcccgataggcatcagaagtaaaagtgtccctaattctgcctcgctgatagaaagggcatttttaatgatgggaatccggctggcccaggaagaaaaaacaagtccgtgggcaaagaaaagtaaaaagcaggctgtgggcattttcgtattaaaagattctctctcattcattataacagggtgataaaattccatggcaaagttaaatacacacatcagttaaaatataatccgtttttgtcatttttacgttccattttaaccaataaagaataaatcacctggcgttttggtagaatatcattttgcttttggtttacagatctttaattttcattaatttcgttcataaaaatgaaccatgaaagaaaaatggattccctatccaacaattttagaaggaaaaacagttgaactgatacctcttgaaaaagaacattttaaagagttacatgctgcggctgcagataaagaactttgggaactgattcctacagactgctcagacagaactgtattttataaaacctatgagtttacccttagtgaaagagaaaccggaaatcaatatccgtttgtaatacgtcataaagaaactcagaaactgataggttctactcgtttttttgaaatctatccttccgataaaaaactggaaatcggatggacgtggattacaaaagagttctggggaacagccgttaatcttgaatgtaaactattgcttttaaccttctgtttttgatactctgaaaaccaacagagtacagttaaaaacaaaagacaataacttcaggtcaagaaaggccattgaaaagattggtgatgtatttgaaggtatcttacgaaaagacaaagtatcaagtgacggaactacaagaaatgctgcctattacagtattctcgatgatgaatggaataatgcgaagcttacaattgaaaaactgatcaaggaaaaacaataagttcattacaaatcactagcaggtatggacaaaaaaacacccggcatcggagccgggtaaatatctctaattgaatgattgtctgtaactcaacggtgttttatccgtcttctttttaaacagtttattgaacgactgcggatgttcaaatcccagtgcgtaggctacctctgatacggagaaacctgttgtagtaagatattcttttgccttttcaatcagtttttcatgaatatgttgttgagcattcagccctgtaatattacggagcatatcacttaggtaatgaggtgataaattcaacgtggaagccagaaattcaacggtaggaagtcccttgttcagcgtttcctgcttgttgaaataatcttccagcacagtatccattttcgtcagcagatcatgattgacagcctttcttgtaataaactgtcttttataaaagcgattgctgtaattgagaagtacttcaatataagaaatgataacatcctggcttacttcatcaatcgatgtattcagctcatatctgatgttatccagaagtcccgttattgttgttttttcctgatcagacaggtgaagcgcctcattggtatcataagaaaagaaaccgaagttcttaatgtttctggcgagaggataacttctgataaaatccggatgtacaagtaaagtatagccggaatattcggcattttcttcagttgaaaggacctgccccggagccgtaaacatcattcctccttcattgaaatcataatatccctgtccatagcccatttttccattggtagaatatttatacgaaattttataaaaatccagagtaaaacttctcttcagcatctctttattgaccttcatttttgtattatccacaaggcttaccaacggatgaagaggtttgggaagctgcaggatatcatgcagttccgatatggatgaaattttcaaaggaacgttgtctttcttttccattatataaagttataaattattagaggaaaagacagcataaatgtgatttactttatactgccttttaagtttcggattacataaactgcttacggaattcttctctgaaagcttcatctcctacttcaatacgctgtgcatataatgcttttgcgtcttcaccagcaacgtatctcaactgttttttaccgtctgtagctgcttcatataccacttctgcaatctgctccggtgtagaagcagtttccatcatctctcccatcttagaaaacagggagttcgtcatttcatcatacgccggagtggatgctgaatccaaggaacggcttacaaaatctgttttgatacctcccggagacacggttttaatgtctacaccaaatggattaagctcaaaagcaaggctttcgctccagccttccagtgcccatttggttgcatgataagtagaacctaacggaaaagcaatcagacctccaattgaagtggtggaaataaacattccgttctttttctctctgaaataaggaataaatgcctgtgttacccgtataacacctaataaattagtatccagctgttttacgatctgatcatcagaaagcgcttccaaaggtcctataagtccatatcctgcgttgttgtaaaccacatcaatgtctcccagctcaagagcctgcttaacggttgacttgatctgttccggattggtaacgtccagcggaagtacagttacattttccaaagcagcaagatcagccgctgcttcagggtttctcatggtagcgattaccttccatcctttgctttgaaataattgggcagttgcttttcctaatcctgtagaagcacctgttataaaaattgttttcattttttcttgttttaaaattacatgacaaagttctgcattggaagaaaaccgggagttgccaaaatggggtaagctgtagccaaaacggatatgaaatagatttgttttttgtaagtttgttctatcaattttatggcagaatatattcttgacaacgtcaatatcagtacactttccgtatacgacctgctgaaacatacctcagacagcacatttatcgggatcagggattttcgggacatctcccccgttgccattgaaaaagacaccggaatatttaccaaacagtctactttacatgattttccaatggtaaacattaccagaatcggaagttcattgctttgctcctgtacctgtaacaatgaaaaaaagcagctttgcattcatcaggcagaaattatccattgtatcatagaagataaaaattacaggctgtttttcgatgatatgctccgtaaaaaggtttttcttcctaaagcaaaaggatatggtcttgaaaacgaaccggacctggaccagtactttgagctgcaatatattgacggcagaattgaggttgtttccaaaatcaaggaaatgcttcctgtagatgatgtcattttaaaaagagatctggtgcctcagttttcttcaaaactggatgaactggctgttcaggaaacagctaaaaaacaaatcctagtaattggtaaacacaggtattataaccacctgaccttttcgctgatggaagcagaaacaacacagtccggaaaaataaaaaatccgatttctcctgtagatgccatgcagctgatatggaaagcagaacaacctgcagacattaagttttacacagccattacttcctttcagaacaattataatgaggattacaatccggcagaactggaagctttaaagctcatcgtacagaaccctctggaacttgaagtttattatcatgaccgggaaatcgcagaaaccgtttctgcaaaatcactttttaaggttgaattaaacactttaaatgcggaggtacaattatctgtatttaagaaagatccgttttatgaaataacaggagaattgcaattcaacgatgtgtctgtcccttttaaaaatgttgttctcagaaatgaatattttgtatataactgtaacattttcagttttgtagatgatccagacatgctcaaaatcataaggttttttaaggctaataatgagattttactggttcattcttcaaaatacgaggcatttatgcagaatatcctatcagccattgaagaacgtatccgcatcaattacagctatatacagcctgcaacagaagtacagcttgaagataagaattatcaggttgaaaaagtcatttatcttcgccagcaggaaaattatataggaattacaccggtcatgaaatatggtgacatagaagttccggtgtattcaagaaagcagatttttgatactgatcagaatggcaatccatttaaaatagaaagaaacgaatcagcagaagcccgttttacctccctgattatgcagcagcatcctgattttgaggatcagatggatgggtatcagtatttttatcttcacagagataagttcatggataacaactggtttctcaatgcttttgagacctggcgaaatgaaggtataacgattcttggatttaacgaattaaaaaacaataaattaaacgcccaccgggctaaaatcaatattcagattacgagcggactggattggtttaatgctaaattaaaagtaggatttggtcctaaggaagcttctttaaaacaacttcaccgtgcgatccggaacaagagtaaattcgtccagttagatgacggcagcatgggaattctccctgaagaatggatggaaaagatatccgcctgtttccgggcaggagaaattgatgaagaaatcctgaaaattcctaaaatcaattttacggaagtgacatcgctgttcgaaaaagaaatcctgagcaaagaaattcaggaagagcttacctcctattcggcaaagttttcaaaagtaaaggatattccggaaacagctattcctgctgaactgaaagcagaactcagggattaccagcatgacgggcttaactggcttaactttctggatgatttcaacttcggcggatgtcttgcagatgacatgggtcttggaaaaacgatccagatcattgccttcattctttcccagagagaaaaaagagggcataccaccaacctggttgtggctcctacttccctgctgttcaactggcaggaagaaatcagcagatttgcaccatctgtaaaggttctgcttcactatggtgcagaccggcctaaagcaactgctcatatgtccgaatacgaagttgttctcaccacgtacggaatgctgctttcagacattaagtttctgaaaggttttaatttcaattatgtatttctggacgaatcccaggttattaaaaatccgaattctgaaagatataaagctgctcgtctgcttcaatcacgaaacaggattgtactgaccggtactcctgtggaaaacagtacttttgacctatatagccagctgtcttttgcctgtcccggattgttgggtagcaagcagtattttaaagatatttatgccattcccattgataagtttgaatacagcaaacgcgctatggaacttcagcaaaaaataaaacctttcatcctcagaagaacgaagaaacaggttgccaaagagcttccggagaagacggaaacagtcatttactgtgaaatgaatacggaacagcgcaagatttatgatgcctatgaaaaagagctccgtgaatttgttgcggctaatgatgacgatgaccttaacaaaaacagcatgcacgttcttacgggacttacaaggctcagacagatctgtaattcccctgttttgatgaaagagggatattccggtgaaaatgccgtgaaaattgaaattctgacggagcagatccttggaaagtcaaaagaccataaaatccttgttttctcacagtttgtcggaatgctggatctgataaaagcagaattggaacaacacaatatcgggtatgaatatttaacagggcagacgaaagaccggggagaaaaggtaacgcatttccagaacaatgaagatatccgggtatttcttatcagcttaaaggctggcggcgttggtctcaatcttactcaggcagattatatctatctggtagatccatggtggaatcctgcagcggaaaatcaggccattgaccgcagttaccgtataggacagaccaaaaatgtaattgctgtacgaatgatctgttccaataccgttgaagaaaaaatccttacgcttcagaaaaagaaaaagcaactggctcagaacctgctcactaccgatggaaagaaacttcagggattgtctaagcaggatctcatggatttacttggatccggttcataatgtgcattctttttataagcttaaacagaagcctttacagttttaaaaaaaataaaaccgacaggtaaaaagcctgtcgataaaaaaacaaaaattgatatggatatgatttagatatgatgtgtctgttgtatcttcttcctgctgaattattagaggaagtctttaaaatattatttttttcttgagacaaatttatatttatttagaattaataaaaataataaagcaatgatatttatcattcaatcaaaaataactcctcataattaaaataaaatacaatttaaaacagattatcaatatactatacataaacagacccatcctgaatttcaagaaaggcctgttctatataattagtaatctaagtattaaactgtttaacttatattttcaataagaattgctgaagcgccccctccaccattacagatggcagctataccgtatcttcctttttcctgacgaagtacattgacaagagtggtaacgattcttgctcctgaagcgccaataggatgtcccaaagcaactgccccaccatatacattcactttgctgagatcatagccgagaatctgctggttggataaaataacagaggaataggcttcattgatttcgaaataatcaatatctgataaagtgagccctgtctgtttcaggattttctgaatcgctacagaaggagatgtggtaaaccattccggagcctgggctgcatctgcataagcgacgatcctggccaatggattcagatgatagtgttctaaagcttcctgagagcctaacaggatggctgctgctccgtcgttcagattactggagttggcagcggtcagtgttccgtctgcttcaaatgcaggtttaaggagagaaattttctccggaatcaatttgtcaatatcttcgtctttatcaacagttgttgtttcttttttaccttccactggtattgtgatcagttcattattaaatttaccggcttttgcagcttcctgggctctctggtatgaaagcagcgcatattcatcaagctgctgccttgttaatccatactttttcacacctaattctgctgcacttcccatgtgaaaatcattatagacatcccacagcccgtcttttatcaatccatcaatgaggctggtatctcctaatttgtttccctgccgtagttttacgtaatgcggaacattactcatactttccattcctcctgtcataacgatattttccaatccaagctgaatctgctgggcaccaatcatggctgatttcattccggatgcgcaaaccttgttgattgttgtggcgtctttatcaacaggaattcctgcaaaaattgcagcctgtcttgccggcgattgcccaagtcctgcactcagtacatttcccatatatacactgtctatatgttccggagtaagtccaaggctttcaaagctgttctttatggcaatagccccaagctgaggagctgtaaagccggaaaggcttcccataaaaccaccaacaggggttcgttttgctgctacaataaatacttctttcatagatttaaattttactatataccgatcagtatattttaaattaaaaaaaatccctttttatctgcaagggaacctaacaaagataataaaaatataccgattggtatattaaaaatacagaaaaaatcttacttgtaagggtaagattttaaacttcttatgctctgctcagctggtccagctttttcagcagtgttggtattctgtaattgccatgcatcttttccagcatcagtttagcttcatccacatcaattcccctggcagtaacaaaaagcggagttttgctttctccacggaatacgcttctgcgttgagaatccggagttgtgaattcattttttgccactccaacgataggacatttgatttccaaagcttcataaagatgtcctcccagtcctatttttccgtcattatccaaagtaacatatccgtcaacaatgataatgtctcctggccttaatgcaatttttgtcagcagactcaaaatgcagggtaattctctcttgtaaaaggctccactttcatattccgaacttacaggtgtttgttctataaaggtttccacttctttttcagatgtccagtcttcaaatgcaatacatacggtattggcataatcttcataatagtaggtatcaaatgcgtaaatcatatttctttcttaaaaaactcaccgaaatgccacaaaattcccgacggatcatgtacaaaacattctttcccccaatccattgttcttacgggagtaagcttcacatttttatattgatctgtaagtctcaaagacaaaagttctctccagaaatcatcggtgttggcaacttccataaaaatcatagtattgtcaacccagtcttttgcataataatcctgaaggtaaaagcctgtttcatcccttataaacagggagagttttggctccagaacaatttcttcaaatcccagatccctgtaaaagtttctgctgatctcaaagtcctgtgcaccaataaaaggtctgatggatttaactgttggtttcatatccctgattttttgagtctgtttttaatccttgccaaggttttaaatcttaagcaagaattaacttcctgattattttctgtcaactaccagtctttcttctctgttggcaatgtcccatgcagtggtgaaaataagttgggttcttttctccagcaactgataatcaatcttttcaggatcatctgttggcttatgatagtcttcatgaatgccatcaaagaagaatgctacaggaatattatgcttggcaaaattatagtggtctgaacggtaatacaactgttcaggatcattcaaatcatcatatttgtaattcagctccaggttgttggttcttttatttgcggcttcattaattactttaagctgagaacttaacatgtcagaaccaattacgtacacatactgttttcccctgttggcaggatcatcacgtcctatcatatctatattaagatcaacaacagtattggctaatggaaaaacaggattttctgaataaaactctgagccaaacaacccatgctcttctccggtaacatgcaggaacaaaacagatcttttaggcccttttcccgcttttttagcctgctggaatgctttggcaatttccattacagctacagttccgcttccgtcatcgtctgccccgttgtatactactccgtttttggtccctacgtgatcatagtgtgcagagaccaccacaatttcctcaggtttttcacttccttcgataaaggcaagaatattctcggaatcaggaaggtttcctcctcctctttttttcatgaattcagccggaactttctgatagtaagaatgtagtgctttaggcgctgaaattcccaggcttttataatagttaacgatatactcacccgcttttttctgccctttgcttccggtatcacgtccttccatatcatctgctgcaatcacatacaggtttttctttaaatccgctgcattaatttctttataggcattgttaaatgctttattatgttttgttgaaacaggatgtgaagcgtttccgtcagatatttttgccgttccgcaactggtcatcatcgccattgcaaataacggaataagtatttttttcataaagaataaatttcttaaaaataacaatttttattcaaccataatatgattaataaatatgacaaaacaataaacaatttattatggatttaacaacaaatcagcttaaaaaataattcgatattaaaattttattatatttgatttaaatacaaaataggtggataaaatttacggatttacacattactccttttttacggaaatgtctgaactggcagccagacacggaagctttgatctttctctgggacttcccgattttgatattgatgaacgcctaagggtatttttaaaagaagctgcagacgagcagacccatcattatgaacctctcgcaggaaaccctctcctgattgaaagtattatccgtttcaacgcaaaaagactccataaaatttctattacaaccaatgaagttactgttgtcccatgtgcaacctttgctttatatacctccctcaaatctgttattaatcagaatgatgaagtgatcattattcagccgtcttattatacctacggacctgctgttgtcatgaatgggggaattcctgtttattatgatcttgaagaagactttacaatcaactgggacttgtttaaaaactgtattagtgaaaaaacaaaagcaatcattgtcaattctccccagaatccaaccggaaaaatatggacaaaggaagactggcatcagttatatgaactgattaaagaccggaatatctatttgatttccgaagaaatatacgatacttactgctacgatgaaacggaacattacagttctttcattcatccggggctcagggaaaagaccttctgtattttttcttttggcaaaatgtttcatacttccggatggaaagtaagctatatgctcacttctgaagctttaacaaagaaatttcgatgccatcaacaatatatttcctacggcgccaatgctccggctcaatttgctatcgcaaaatatcttgatgtatttgatccggatatcaataaaaagctcatgcagaagaaaagagatatttttaatgaaatgattaaagaaacccctttccagatcgaacaacaagcggaaggaagtgttttccaggttgttaatttcagaaatatttctaaaaacatgaccgatgtagagttttcaaagtggctgacgattgagaaaaaggtttcgtgtctcccactttcggctttttataattcgagacagaattcggattatgtcagattcagttttgctaaaaaggatgaactgattattcaggcactggaacatttgagaaagaacctttaatcattttacatatttattttttcctgcagatcacacagacttgcacagatgatggtgaatattttattttttgctgttgtctttcttgatctaaatgacaaacaaatatgataaaaaaagcaccgccaaagcgatgctttcctattattttaatattgattttaaagagccagaacccttacatcaattcttctgttttttgctttacactcatctgtatcattagcttcgcatacaggatgctgagatccgtaaccttctgcttctattctgtctgctgaaacccctagctcaagtaatttaagcttcgctgtttgtgctctcaggttagacagactaagattactttcttcatttccactgttatctgtataaccgcctaattttattttaaggttggggtaagcatttaaaatttcagccagcgtgtttaactgaagttcatagcctggttttaaatcgcttgaacctgtttcaaaataaaggttttctatcgtgtaccacttattaggatccagggcagatttatctttttgcttaaccacattatacagctgataaagctggcttccgtctccgatagcaattgtttttcctccctccagttttattttctgaatatttcccgtttcgtacacaaagtccccgttttcattaagatgtccctgaacctgaccgggaacaacctgaattgctttagaatcagtaacgacagtagcagtgccggttactccggtaagactttcaatctttgcttttctgttcgcttcaattttatctttatgcagcacagccagagtaggcgcaataaccaaagaaacgattgacattaatttgatcaggatattcatagaaggccctgatgtatctttaaacggatctcctaccgtatctccggttacggaagctttatgaggctctgaacctttgtaataggtttgtccgttgatgtccactcccttttcaaatgattttttggcgttatcccaggcccctccggcattattctggaacattcccatcaaaactccgcaaacagtggcgcccgccaggaatcctcccaaaacctcaggtccgaaaataaatccgatcagtaagggagaaataatggctatcgcaccgggaagcatcatttttctgatggatgcatctgtagaaatagcaacacatttttcgtattcaggttgtgcttttccttccagaattccgggaatttcacggaactgtctccttacttcttctaccattgccatagctgcctgtccaactgctgtgattgccaatgatgagaaaataaaaggtatcattccgccaacaaatagtcccgccagaacgtctgctctgtaaatatcaataccgtcaattcctgcgattcctacaaatgccgcaaataaggctaaagcagtcaaagcagctgaagcaatagcaaatccttttccggtagcagccgttgtatttcctacagcatccagaatatctgttttctctcttacttctttcggcagctcactcatctcagcaatacctcccgcattatcggcaataggaccaaacgcatcgatggcaagttgcatggctgtagtagccatcattccggctgctgcaatagcaactccataaagtcccgcacagagataagaaccatagatacctcctgccagtacaataatcggaagcaaggtagattccatcccaacggatagccctccgatgatattggttgcatgccctgtagaagactgtctcacaatgctggaaaccggtcttttacccattgctgtataatattctgtaataatactcattaaagttcctacaaccagtccaaccattatggccccgaaaactcccattttggtaaattcatggcctctgagaaccattttttcaggaaggatatatgttaccaggaagtaagaagcaatagcagtaatcacaatacttccccagtttccaaggttaagcgcattctgaacacttgaagtggatgaaccttcattatcatttacttttacgaataaagttccgaccattgaaaatataattcctgttcctgcaataagcatcggtaaaagaatcggggcaaaacctccgaaagcatcatcagaaactgtttctctccccaataccatggtggctaaaaccgttgccacataagatccgaaaaggtcagctcccattcctgctacatcccctacattgtctcctacgttatctgcaatggttgcaggatttctggggtcatcttccgggattccggcttcaacttttcctacaaggtcagcacctacgtctgccgcttttgtataaataccgccacctactcttgcaaaaagcgctatggattctgcaccaagagaaaatccggtgagaatttcaatggttctttccatttcatgagaatctactgtagcatccggcgcaaaaaactgtttaataatcagaaataaggctcccaaacctaaaacagctagtccggcaacccccattcccattactgaacctccggtaaaggatactttaagagccttcgacagtgaagttctcgccgcttctgccgttctgacattagctttggtagcgattttcattccgatgaatcctgcacaggcagagaatatagcccccaccacaaaagcgattccgatactccaatgtgaattggcattactagaccccatcactgccagtaaaatagcaaccactacaacaaagtacgttaagattttgtattcagcctttagaaaagccattgcaccgtctgcaatatgcccgctgattgttttcattttttcatttccggcattctgtttattgacccagttgctctgaagaaatgtataaagcaaagctatgacaccaaaaattggcactaacacaaatagatccatagtttattattttatattaaaaaattgagattagtcttataaatataatgaaattataaacacaccataaaattcattaataataatctattattttgtaaatttgtttctcactatgatttgaattaattatttatgagaaagatactatacacccttatcctatctgcaggcgtaagcagctgtcatcataagatgccacaggaaaaagctgaaatactatatttcggaggacctattataacaatggaggattcttctccacaggttgaagcagtagccgttaaagacgggaaaatactttttgccggaacaaaatcagatgcagaacgtttttcaggatcagccactaaattgattaacttaaatggaaagactcttcttcccggttttatagatgttcatggacatcttacatcaagagccgggattatggatgctgtagatctgtcccccgaaccttatggcactgtaaattctattaaagatttacagattacgattaaaaactacatcaaagacaataaaatctcagttcaacagccaattatcggaaatggttatgatgatgcaataatgacggaacaccgtcatcctacaagaacagaacttgatgtcatcagcaaaaccaatcctattattgtcattcacgcctcaggtcatgccagcgtagcaaacagtgcaatgctgcaacttctggggattacggaatcatcaaaagatcctgaaggaggacatattggcagagataaagcaacaggaaaactgaatggaaagttggaagagaatgccagcttcacagcgttgctgaccttaacggaaaaaatgagtaaaggcaaagatactcaggctcatgccatggaaaacctgatgaaagcccaggatgaatggctcagctatgggcaaacgactatttgtgatggaagaactatgggagaaagtgtagatttgttagaaaaggcagcttctcaacatctttttaaagccgatattgtttactttcctgattatgaatatttcaaaaaagatttcagcaatttcaagccaaagtatatgaagtatgaaaatcgtttgaaactggctggcttcaaattttctgatgatggttctcctcagggaaaaacagcctggttgacacagccttatttagttccgccggaaggtcagtctaaagactataaaggatttcccatttttacggatgaaactttatataacgatctgaaaacacttttccagaatcatatcactgcgcagcttcatgtaaacggagatgcagcaattgatcaggctatacgcgttatcaaaaggttaaaagatgaaaatatttaccagccgaaattgcgcgcaacattaattcatgtacaaaacagccgccctgatcatattcaaaagataaaagaaataggggtaattccttcttacttttctactcatgcttatttatggggagattggcattactcaagtgtttttggtcccgaaagagcagcttttataagtccggccagctctgcattaaaagcaggcattacctttacgattcatcatgacgctccggttactccaccagatctgataacggcagtatacgcagcagtgaatagaaaaacgcgctcaggaatgattttaggacctaatgaaagaatctctcccattggagctctaaaagcgattaccattaacggagcttatcagttgcaggaagaaaatagaaaaggatctattaaagcaggtaaaatagcggactttgtcattctggatcagaatcctttaacgataaatcctgaaaatcttagaaagatcaaagttcttgaaactataaaagaaggaaaatcagtgtataaaagaaattaaacctgctggtacagaataaatattcacaaaaaaagcagatgaaaaaatcatctgcttttttattattctagggaagaacatcttatcctccgaatttatctgcatagtctgtttgagaagctttgatcacttttcttgcgtgttcagctccgtaaacttcctggattctgcattttgcaggctcatccggtaagtttttgtacgttaggaaatagtgcattaatcttttcacttctgcttcaggtaattcagaaatatctctgaaatgcccgaaagcgtgatcattgatcattactgcaacaattttatcatccgcttcacctccgtcgatcattttaaaaccaccaattggaatagcttccatcaaaagacctccggcgtggatgttgtgagaacttaaaacacaaatatcaagcgggtcatgatctcccattgtaacgtcatcagctcctgattctacagcaagtctcatcacttctttatcacagtatgttcttggaacaaacccatacaaagcagggataatgttagaaaatttctgcggcctgtctacctttaaatatcctgtttctttatctacttcatatttaatagtatctgaaggaacaatttccacaaatacatttacaacatttggcgcatcttctcctgcagaaattccgtgccatggatgtgctttaaaatttggaatcattatttatctgttattttttaagttattattaaaatttcttttcttaaatcttctattgtttcggcaatataatcgttgccttccatataattcatgatgaaaaccgttttgaattcatccagctgaacctctcccttcagcccgtcataggttttatgaagcagttctataattgcattttttgagtctacaatattcttccatgaattttttgtaatgtataactgttgggatgagttatattcaaactcttcattgatcgctttttctgtaaggaaaataaactcatgaacggccagccctctgtcaaatctatgaataaggtttgaaggcttaatcctatccagaaacaatgtcattctttcataggaatgtactttgttctctgaatttgatttcacagtaagtaatttgatttcctggttcttaagagtaatgtatgagtgtacaaattgtctgaacaaaaccagaaaaggaattgcaacaatcaatgcaaatgcatatggtaaatatcctgagagactcgtcataattttagactgcaaaattactaattattttccgtcttctaaagagtttttaaagatatccactttagaaatttgtatatagatcaaagagagaataatgataagatagaagccaaccatcatcctgtttaccagagccggaaaaatcagaaatctcaacataacagttccataaataacagcaaaaaacaagacctgagcctggttttttttattgcagaaagaaaaatgattggccagaatgaccactataaaaatcagtaagattggaaaataggaagaattgaattccagcattatattacttttaataaaatgaatataatctgaaaaggagaacggatcaggctgtgaaacgggataaatctgaacttccgtaaattgattcataaaaagcgtagaccacgacacatgattaaaagcttgtattaaacagaaagaaagaaacaaatatccgtatgatatcaataacggcgctgttttaatctgaaacctgtttctatataaataaacaaagacatacaagaatgaataaaaaataaaatattccggtcttgtaagcacacatagcatacctaatatacctgcccagaaaatattcttcctcattaaaaaaatatagaagctgagaagaagaagaaggcatgataaagaatccgcagaaacgtgccgggcagattccggcaaaggtttgaacattgaaattaaaatagtgaggataagggcaagcggataatttttcaggatccttattaaaaagctgaaaatcagaataagaatgcatgcataagaaatagccgaaattaaagagatcgaggcagaagcactgaaaccaagtttaaagaatgaccagccgataaagttatagaaaggcttcaccacaaaaagctgcagctcttcttcatagaccttaggattttgtgaaataattttataataggtgctctccccttctgctacttcttccgctataggatttacaggtccaagcccggcaaaatcaggattcttttccctcaattcatcgtataccttcttatgaatatcctcaattttcatatcagggtattccgttttataaatcagccccatataggcttccatatcagtattgtaatagtggttggtatacagatagtatgacatgaagcatacgtagattgaaaagataaaaacaagaataccgttctttttttccatatactgatattatatgaatacaaatgtaaaaaaactatcttttaatctgtattcccaggaaagtttactaaaggatcagtatactatagttcaaacagggccggtctttgtgttacttcatggtaacagacactgttttcatcaaagaagtggtatacaaggctttttctggttctgtttttatctgtatgaggttctcctccatgaagaatattggcatgccagattaataaatctcctttttttgctttaaatatttctttttttaagcctaattcttttactttttcatcaaggaaagtttcataagccctgtagcttttcttgccgattttcaaggcagtgccttcgttatcgtaatcagaattcagaaaataaggaagtttatggcttttaggaatgtaatgcaaagctccgttgctttcatccacatcttccagagcaatccagaccccaagcagtcctcccaacggataagtggtcatatggatactgtctgagtgtgttttctgctggctaccgttgataaaattgatgctttgaaaaagtttggattttccgtccagtaaaacagataaaaaatctaacagttccggatcacttcctatatttttaatgatttccgaatgatgaatggcaaacatcagctttcccccgtaaataaactttaaagtcccgtctttcatcagtttatcaatttcaaaattgatctgatctgccgtttccggagtaagataattccttagaatcatgtacccgttatcatcgtactgaagagcactttctttattttcttcggaaagcttattaaaaaacggagtttctttaagctttgtataatttaccgtcctttcactggccggaaggtgggcaaaatctttactggaaatgcttgagaaatagctcttattgattccgtattttttatacaatggaatattatgctttaatttactctttttaaacaggttataaagcatatatgataatttgtactgacgaatatgttgtaacataactgttttactaaggattttataaagttacggattattacctaattagaaccaatctaaacaatgcttttcatcataaaaaaggctttcctctcaggataagataggccagctttttaaaaagatttatttttgaattctcaataataccataaggtctcaactcgggccggaatcctctgaaaaattcttcaatattgggaagttcgcctccttcaaaatcaaaaatatgggtttcaatattttctttaatgagatgatcaatcaatacagatgctcccgataacttcacataatttttatcattgaaattacctaaaagcgctaccatattgcaatcggaataagtagcaattacattgataatcttctgctgatagtaaaatgcggtaaatttcagataccccagattgtaaaagctctcaaaaatcctcatgaactcagacaggtcatcttccttgctcagccctattgtgttagcttcaatgaaagctctggctttgtcaaaagatgtcgttttaatttcagaatcttttaaaacagcttcatctaaccgaagttttctttttcttttgggtgaatattttgcgtacactttctcataaacctcaggatataataaaaagtttttcttgattctgatctttgtacgaagttgattaacatcattaaaaggatatgcccggatcatgtaatttttttccagatattctaaaaaagcctcatttaaatccaaatcatctttggcagaaaaaacaccaagctgctgacaaagcttaggattatgtacaattttcatcccgtattttcttacaaaaggaacaggcattactgcttcataatctttataaacaagaatttcccagggcattgcagaagtagtatctaaaaaatgctttgtagcagaatattttctttgttcggaattttctaaacattgagcatatttaacaaagtcaatttcatggtattttaatcttctaatcatagtaatcctgaatccgaaaagctaaaataagactcctgtgtgacaataatatggtctaatagctggatgcttaacgtatttccggcttcttttattttctgtgtgatattaatatcttccctgcttggttttaaacttccggaaggatggttgtgcgcaatgataattcctgttgaaaaatgatccagagctcctttataaagagttcttacatctacaatagactggctgatcccaccctgcgtgagttgggagatatgaatcactttattactgttgttcaggaagatagcccagaattcttctgttctcagatccgaaagctggtttctaagaactgcataagcatcatgactattacctattatcgttttttcagggatttcctgtacagctcttctctttccgatttctaaggctgaaatgattgaaatagcctttgtctctccgattcctttgaatttcatcagatctttaacagaaagcaagcttagctgatgccagttgttattaacagaattgagaatttttcttgcaagctccacagcattttcgtccttatttccacttcccatgatgatggctaacagttcagaatcagaaagcgagcttttgcctttctgcaaaaacttttctctgggtctgtcatcttctgcaagaaattttatagccatggaaaattaaaatattatgaattaatagaatgcatataagatcatcggctttttggaatgatcgatgtatttagcagtttctttaaaagcatttaccgacagcataggacaacctaaactcaggcatgccggagtttcagattccatatcggaaacacattcgtaagagtgaagaacaatagctctctgcatggcattactgttggtagagtccaaccctgtcaaccgataagctttgccaaactttcctacatagctttctccaatgacatactttccaagtgaagactgataggagccttcaatattactgaattttaaggcgtctgattttggtataacagaacctgagccatgggaaactacagcctgctgtacaatcctgttatttttcaggttataaatgaaataacggtatttaccggaaggttttttaaaattgataaaaacagccagttcctgattatactcttttcctttaatataattcttaatttccaaaattcttgcctgtggcacattaagtgaattcaactgctgagactcagcctttgaacaggaaattacaattaaaagaagaaaaataaagtatttcatcatccggtttagtatactgttattctatgatcattccgtctttcatcacgagtttgcggtcagtaatttctgcaagattcgggttgtgggtaacgatcacaaatgtttgattgtatttgtctctaagatcaaaaaacaatctgtgaaggtcatccgcatttttggaatccaggttaccggttggctcatctgcaaaaataatttttggtgaattgattaaagctctcgccactgctactctttgtgcttctccaccggaaagctggttaggtttgtgattcagcctctgttctatctttaagtcttcaaataaagcataagccttttcaatagcttctctctcatttgctccggctatttttgtcggaagcaatacgttttccagagcggtaaactcaggaagaagctgatgaaactgaaatacaaaaccgatattctgatttctgaattttgatagctgcttatcattcatattgataaatgattctcctgctatttcaatttcagtatcatacttaccggattgggtcggatgatccagcgttcctaaaatctgcagcagtgtagattttcctgctcctgattctcctacaatagaaaccacctctcctgttttgatgtgaatatcaactcctttcagtacttctaaattcccataagacttatggatatttcttgctttaatcatgattcaaaaatagtaaattgccttcaaataaaaaaccgctttttgaagcggtttatattttattttagttttaagatgtttagatttcggtaatccattcaattacgtcttttctgttaatttttttaattattgcttccagattttgggcagaaaacataggttttatgtattattgtatccgttcaattcacaaaaaaacctcccggtttgggaggttttattatttttaattcagaaattacagtaacaatgttaatgggctttccaaataggttcttaatgtctgtaagaactgagcacctgtagcaccgtctactactctgtggtcacaagccaatgaaagtttcatggtgtttccaactacaatctgaccatctttaacgattggtttctcgattattgctcctactgaaaggatagcagagtttggctggttaatgatacttgtaaatgtttcgattccgaacattcctaagttggaaatagagaatgtagatccttccatttcgttagctttaagacctttgtttttagctcttgaagccatatcttttacagctgctgaaatctgtgtataagtcatctggtctgtatttttcaataccggaactaccaatccgtccggaatagctactgccacaccgatgttgatatttcctctgtgaatgatcttatcccctgcccaacttgaatttacctgagggtgttttcttaaagcaatagcagttgctttgatgatcatatcattgaaagagatcttagtatccggtaaagaattgatttcttttctggcctcaatcgctttatccatattgatctcaaccatcagatagtaatgaggcgcagagaatttactttcagaaagacgtttcgcgataacatttcttacctgagagttaggagtctctgtatcttcaccttgtacgaagcttactgcagccggagcagcgcttgctgcaggagctgaagcagctggtttcgcagctggctgatagttttcaatatcttttttaacgattcttccgttttcaccggatccctgaatactgttgatatcaactcctttatcctgagccatctttttagccagtggagagatcgcaaccctgtccgaagatgaagtgtttgcagcaggcgcagctttttcttctgttttagcttcagctttttgctcagccgattttgcagttgactggcccgcagcttttggagcacctaccgcggaaacatctgttccggcagggccaatgattgctaacacggaatcaaccggagcagcccctccttcttctacaccttgcttcaataatactccattgaattcagattcgaaatcctgtactgctttatctgtttcgatttcagcaagaagatctccttcttttactgtatcgcctacatttttgtgccatttagccaccttaccttctgtcattgtatcagaaagtctaggcattgtaataatttctactccagccggaacttctgcagtagcagattcagtggcaggagcctcagctttaggctgttcttctgattttttctcttcagaaccggcacttggagcagcagctcctcctgtcaatcctgaaatatcttctccttcatttccgataattgccaaaacagagtctacagcagcagcacctccctcttctacaccaatgtataaaagggtaccttctacttcagattcgaaatcctgaactgctttatcagtttcaatttcagctaaaatatctccttcttttactttatcccctacttttttatgccattttgccaccttaccttccgtcatcgtgtcggacaggcggggcatcgtaattacttctgccataatttattttaatttgaaaatttagcaatctgaaaatttgaaaattaaaaaaggacataatctatcgcattttcaaattctcaaattgtcaaattaactcattatcttttagttttctaatttgtctaggaatggataatcttcctgagcatatacatactcatagattttttccgggtccggatatggagagttttccatgaactcaatacactcttcaacaaaatctctcgatttgttatcgatagtttccaattccgcttcagtagcccatccgttttctaaaattctgtgttttatcaattcgattgggtcatcatttttgtgaagagcaacttcttctttagatctgtatggctcagcatcagacatagagtgtcctctgtaacggtaagttcttgcttcgatgaaagtaggtccatctcctcttcttgctctttcaatagcttcataagcagcttctgccactttttcaggatccattgcatctacagcaaggcaaggcatttcatatcctaatcctaatttatagatatcttcgtggttggcagttctttttactgaagttcccattgcatactggttgttttctacaacaaatactacaggaagtttccagttcatcgccatgttgaaagtttcgtgtaaagaaccttgtcttgcagcaccgtccccgaagaaacaaatgtttacggcctttctgtcgaaatatttatcagcaaaagcaatacctgcacctaaagggatttgtcctccaacgataccgtgccctccgtaaaaacggtgttctttactgaaaatgtgcatagatccacccatacctccggatgtaccagtagctttaccacaaagttccgccatgattcttttaggatccactcccatcgccattggatgaatgtgacatctgtaagcagtaatcatactgtcctttgtcagatccattgcatgtgtaaacccggcagggatagcttcctgaccgttatacaaatgtaaaaatcctctgatcttttgttttaggtaaagagaacggcatttgtcttcaaaccttctccacattgtcatatcttcataccacttcaggtatacctctttagaaaattctttcatgtgttagctcttgcttttttatgatgaaatagttgagcaaaattatgaaaaaaactttgtttttattctatacatagataacttttcaatttttctgtaaaatctatttgcgggctgaatggattattcttaattttcgagccctgcaggtcctgataaaacgctgttatctcttattcttcatgacgatcataactataaaatatgcctgtttataaggctttcataaaacaacaataaatatgaagcatcagaaatgtttcatattcatccatcaatctgtttcatttttaattattgttaacatagcttttggttatttcaacagcatcttttttttaatgaataaaggtttaagtttcaaacctatccttattttttatcagtaaatgtaaaagcaggattgaaaaactgataaatattttacgtctgaaaagcaattgattatcaaataaattctctgctacccgtccattccccaccattcttcttagttgctttttgaggttataatggtatatttgatcattaaacctgattatggaaggaaaaaagtcttcattactgcacaaaatttcaagagtcatctctgatttttttaatcctctggtctctctgatcctgttttttgtatatatgagtatcagagaatattctcttaaagattccatgctgtactttattcctatattattaatgatcattgtgccgatcatcatatggctggtctggaatgtgaagacgggaagatataccaacatggatgtttctaaccgtgttcagagaaaaacgctgtatatatttattgcagtttgtgtaattgcctatcttatttttaattatgtcagaaacggatatattgatcttgttatgcttttcattttgattcttttatttgcgcttcagatcagcaatctgtttatcaaaagttcgatgcatacagcatttaatatatttgtagcagctctgtttttctcgcttgactggaaaataggtctggtatggctgggaatcgcaattttggttggaatcacccgggttatattaaaaagacacaccgtaaaagaagtatttatgggagctggaatagcttttatggtatcttttatctatctttattgcaatattcaatttcaacattagaatactctatgaaaatacatcatcttactgccgcagaagaaaactttatgaagctgttttggaaaatgggatctttctatctgaaggacgttatggaacagcatccggaaccgaaaccccatcagaatacggtttccacttatttgaaaatattagttgaaaaaggctatttatcaactgtaaaagaaggaagaatcttcaaatataccacgattgttccattggaagagtataaaaaattcctgctgaaagagctttctcataattttttcagtgattcaggaaaggaaatcctggaacttttattaagcgaaaaattaatttcccaggaagatatgaaaggttattttgatcttaaaatcgaaataaagcctgctaaaaccgaagaaccaaagtttgagttggctgaagaaatcttaagtccgaaaaaggagaagaaggccaaaggaaaggagaaagaaaaagacaaggacaaaaagaagaaaaagaaaaaagagtaatctaccttaaaaaacaccaaatcatgaaaacaaaattccaggaaacagtaagccgggccaatgaagccattttccggtatccgatgattctggtaatggctttactggcttctattggtgctatatgcattatagaaacggaacacactgaaattacctcttatataaaatttaccatttgtgcgtgtcttggaatttctctgatgtttgcattaaaaatgctgtcacagagaatcgggaaagaagtactactgcagattttcggtattattttccttattggcttttacttcatcctgcctgataaaaagaattatttcaccgaagtctacgcttatatcattgctgttacagcgcttctctcccacttactggtttcttttatcccgtttctggagaaagacagagaactcagattctggcagtataataaaaatctctttgtcaatatctttcttaccgctgtatttacaggagttctgaccggaggagtggagctggccatcttagcagttgataagctttttgactttaattttcatgatagaatttatagagatactttttttgtcctggctattttcggaagcagctttatctttcttttatttaatgataaagggttaaatgatcttgaaaaagacggaacttatccggttgttttgaagtttttcacccaatttattttaatccctttactgcttatttatgcagtgattctttacttctattccgctaaaatacttatcaactggcaacttccgagaggttgggttacttaccttgttttagcatatagtattgttggtattcttgcattgcttctggtacatccactgaaagaagaaaactcaaaatcatgggtcagaatattctcaaaagcattttattatacgattgttcctttgattatactgctttttacagcgatctttacccgaattctggcatacggttatacagaaccaagatactttgttctcctgcttgccttatggctgttaagtgttgtagcttacttcattttctgcaaaagagcaaccataaaattcattccggtgagtttatttctgtttggcgcttttgctctggttttcccttacctcaatgccttcagcgttacgaaaagaagccagaaaacggaacttatcaatattttgaaccaaaaccggctgatcagtgacggtaaaattaatttccagaagaaaattaccgatacaatccgtgatgaaattgccgataaatttgaatttctggctgaaagaaagcagggagaatttttatcaactttactgaataaggaagatcaggctgaattagctgctcatattgatttcggtacattttacagtatacgatataatattcaaaaaagattttcagatgtgaatgtcacagtagaaaacaaagtatatgaaatgaacaaacagtctcttgttcctgaaaaacaagttgtggaaatcggagactaccagtatctgctttctttctatccttacagcaaaagtccaaaaaagctcaatgatgaccagtttgagcttacagattacctcttcaaaaaatcttcattaaaattaaggctaaattccaaagaggaaatagatttcggaccacaaatcattaagctgtttgatcaaaacaaaaacaagcaaggcatcataaaagtccctgaaatagcaatggaatctgatttaggaaaataccatgtcaaacttattttcagtgaaattacacgggaactgtattcagataataacctgtcaaccatttattatcaaaatgcttatttacttataagattaaaataaaaaataggatatctgcgatatcctatttttattaatgttacatcattctccaacacagaaaattatatcagtcatctaagaatataattttggattcttacgaaacctgaccggagattaaatttcacaaaaaaagcggcttaaaagccgcttcattatttttaccaacgatttccgcctccgccacggttgttaccatagcccccgcctctgttgttgttattaccgtaacctccgcttctgttattatcgaagcttcttcttggtttttcttctcttggtttagcttcagatacgtttaaagtctttccgttgaattctttttggttaagagattcaatagcctgctttccttcatcatcacccatctctacgaaaccgaaacctctggaacgaccagtttctctgtctgtaacgattttagctgatgatacatctccaaattctgcgaatagatcgtgcaactcatactctttagttgcgtaattgatgtttgaaacaaaaatgttcattttaaataaattaaaaaattaataaaaatttggtatataaaagaaaaacaacataaattaatgaacaaatattgattccaaatataaacgtatgcaagatacaattaaaaatttcaaatcaaagctttttttacatatttctcacattatgttgaatcgggattactaaatacaataaataaaccaaataaacaattgatataaaacaacttacactacattaattcttttagttaaattatttaacatttaagtatcaatcataattttttttaacttttaactcacagaaaatatgaaacaacacaccaccaattatatcaatacgcttattgaagttgctgaagactgccctgtttcccaagcgaatattcctgctgaaaagaaagaaaaaacactggccaatctccaatatgaaaaactcataaagaatccctatcaatattcttcagatgatattatttttgagtgttatgccattaaaaatgacattccggaaagtgaaagacagcatgaaagagaaaagttcttctccaagggacagccttgtctccgctgttctcctttagcaaaaagatacggtttcggatttcatcacaacacagaaggaaaagttgccctggttcctatggaaagtaaagaatatgaaaaattactgaatgattcctccatagcaaaaaccagagccatgcgttccaaaagaaaatgattgagaaaatgaatgattcttttcagatcaataaatgctattgttttgaaaagatcagcttttaacagtaaatttgtattgcaaattattaaaagatgaactatcatacaagaaaatgggtaaaacccgaagatttaaatcctaaccactcacttttcgggggaagactccttcaatggattgatgaagaagcagcgctgtatgcaattatccaattggaaaacacaaaagtggtgactaagtttatctccgaaattaactttgtcagctccgccaaacagggagacattatagaaataggaattgaggccacccatttcggatcctcctctattacattaagatgtgatgtgcgaaataaaatgactcatcaaacgattattaccgtagacaaaattgtaatggtaaaccttgacgcagatggtaatcctgctcctcatggcaaaaccagaatcgaatttgtaaaagacaggttaaacagcggcttatgaaaattttcataaaaaatatggtctgcaacaggtgcattgcggcagtggaaaacattttccgtaatgcagatgtgaagatcaaagatattttgctgggagaaatagaaaccgaaactgatatttctccggaaaaaatgaagtttatagagaaagaattactgaatacaggtttcgaaagaattatggattctgcccatcagcttgttgaaaaaatcaaaaaccttattattacaaaggtcagcgagctggatattgcagaaaatttcctgctttctgaatttttaagctcaaaacttcataaagattacagttccctttcaaaaacattttcacagaatgaaaatattaccttggaacagttcttcattcttcagaaaattgaaaaagtaaaagaactcttactctataacgaattcaatcttactgaaattgcaggaaaactaggctataaaagtgttcagcatctttctacccaattccggaatgtaaccggatttacccccacagaattcaaaaaactgaaagagcatcaccgcaaagcgcttgataccttataaacaggagtgtttgagaatttataaaaagatatttaactccttcacccaaaaactctcaaacactctcaccttaccactctcaaactctccaacctaattttataactattatccttaaatttataacaaccttacttttccattttggaaatttgtagtataaatttaagaatcatggaacaacagtataaaatactcggaatgacctgttcaggctgccagaaaaagatttcaaatcagctgaacagccttgatggagtgaaagccgatgtaaacctggaaaccaataccgcaaccatcacttctgaccatggagtgaagctttccgttttaaatgatgcactggcagaaataggaaaatacaggcttgaagatcctgataatcctgaaaaaacctttgtaaagccccaggatcgcgtatcgccgtcttcagtatactattgcccgatggaatgcgagggagataaagtctatttcaaacagggagaaagatgccctttttgcaatatgtatcttgtacccattgaagaaaagctggccaaagatcctcatcacaaaccggcttattctgcagcccatcttcctgaaaactttaaagacagcattggaaaatattattgccctatgttttgtgaaggagataaagtatatgatgaaaagggagattgtccggtttgccatatgcatttggaacctatcactgaagaactagttcagaaagcaggcgctcatcagcatcattcccattcccactctcacaaccatcatcatgacgcacctaaagtaacagatgaaatggcaggcagatattactgtccgatgtattgcgaaggagataagacttacgattccaatgtcggatgtccggtatgtggaatggaccttgtaaaataccctgaaaagaaaactgctaaatatacctgtcctatgcacccggaaattatccgggatgaaccgggagactgtccgatctgtgggatggatctcgtcagaatgcctgacagcggtgatgatgaagaagatgaaacctatactatcttaaaaagaaaattcattatttcattaacattcaccattccggttttcattctctcgatgggaggaatgtttatcaacttccctttttcccatcaggttcagggatttattgagcttgctctgactcttccggtgatgttttattccgggtggttcttattaaaaagaggctgggtttctttcaaaacatggaatcttaatatgttcagccttattgccctgggcgtagctgcggcatttattttcagtattgctgctttaattttcccggatatcattccacatgaaatccgtggacataatcatgaaattccgctgtattttgaagcggtctgtgtaattttaacgcttgttattttaggtcagctgatggaagctgctgctcataaaaaaacaggaaatgccatcaaagaattgatgaacctttcgcccgatgaagccaatcttatggtgaacggtgaagaaaaaagagtgttactttcacaggtaaaaataggagatttattaaaagtgaaacccggtgaaaaaattccggtagacggaaaaatcactgaaggcagttctgttgtagacgaaagcatgatcacgggagagcctgttccggttgaaaaaaatgttgatgataaagtatcttcaggaacaataaacggaaaccaggtattcatcatgaaagcggaaaaagtaggtgacgaaaccctgctttcacagatcattaaaatggtcaatgaagccagccgaagtaaggctcctattcagaaacttacggataaagtctcaaaagtatttgttcctgtcgtgatccttattgctgcgcttacctttgttctgtggcagtttttcggtccggaaggaaaaagaagcttatttgccttcgtcaatgcagttgctgtactgattgtagcttgtccctgcgcattaggactggcaacgccaatgtcgttaatggtaggaatcgggaaaggtgctaaaaacggaattctgatcaaaaatgctgaagcacttgagcaaatgaacaaggtgaatgttttgatcactgacaaaacaggaactttaacagaagggaaaccttcggtagaatatatagaaacggctttcggtgatcagaatcagattttaaagctggctttttccctaaatcaaaattctgagcatccattatccaacgccgttataaaaagagcaaaggatgaaaatacaattgctgaaaaagtagaccgttttgaaaacatttccggaaaaggagtgaaaggaaatattaatggaaaaacagcgtatttaggaaatgaaagtctgctggcctcacatcagatccagattcctgaaactttaaaacaaaaagcagtagaagtacagtccaaagcgcatacgatttcttatgtcgcacaagaccagcaagtacttggattcattagttttacggataaaatcaaggaaagctctaagaaagctgttaaacaattaatgagcgaaggcattgatgtgatcatgatgaccggggacaacgaacacactgccaaagctgtagctgatgaattaggaatcaaacatttcaaagcaaattgtcttcccgaagataaactgaatgaagtgaaaaaactgcagcagcaaggaaaaatagtagccatgaccggggacggaatcaatgactcccctgccctggcccagtctgatgtgggaattgctatgggaacaggaacggatgttgccatcgaaagtgctgagatcactttattaaaaggcgatatcttaggggtagcgaaagccaaactactcagcgaaaagcttctcaaaaatattaaagaaaacttattctttgcttttatttataatgtactcggggttcccgttgcggcaggattattgtatccattctttggaattctgttatcaccaatgattgcagctgcagcaatgagcttcagttctctttctgtgattctgaattcattgagattaaactccgtggatctggatataaaatagcattatgaaaaaagaaaatctttacatagggtgttcgggattttataataacgactggaaagggtctttataccctgaaaatgcccaaagtaaagattttctttctttatattcaaaaacattcaattctgtagaaatcaattctactttttacagaaaaccaacctcaaaaacactgtcgaaatggtatgatgaaactccggacgaattcaggttttttattaaaattccaaaatccgttacccatcagaaccggcttgaaaactcaaaagaagaaattgccctcttttgcagtcatattgagagtaatctcaaggagaaactttccggatttctctatcagcttcctccttcctttaaaaattcaactgagaacacagaaagaatcatcaacaatattgatcatcgatttctgaatgtcattgaattccgtcacaactcatggtggcaaaaagaaatatttgatcttttaaaagaccatgatatcattttttccggagtaagctttcccggtgatcttcctgaagatataatcatcaatcatccggatattctttattacagacttcatgggaaacccattctttataaatctgagtacggcagggattttatggataaccttgctgagaaaattaaaaacagcaggaaaacagcttatatattcttcaataatacctggggaaccgctgcgattaacaattcattgtatttgaaaaacattttagaataaacctctgattttgttaaaataaaataattccccaataaatgaaagatattgaaatcttaacaaatatagagaaaagctatcggtttcgtatttataaatgttaaaaataaaagaaaaggaaattataaatttataacattctataaaattgaaatatcctttaaaataaagttcttaaaataagcttaaaaaggaaatcacctgcacagcatggcatataatttgttaactttcaattgttatttttaacgatttttaacaatttaaaattccactatttttatgagaaaaatttttgcgggaaagtcaaaaaataagacttttctcgggatgtttgcattggtgagtgcaacttcggttttattgaacagctgtaatttcaagagtgaagtgaatactgactccgccgtcagttcacaggaacatcctgccgcagaaatagtccccaagatggacgatgaaagcgtagacccggataaaagagtgatctaccttacctttgatgacggtcccaaccagggcaccgaaaatctcttaaagattctggacaaaagaaacgtttgtgcaactgcctttctggttgggaaacatgcatatggaagcaaaaaacagaaagacgatctgttgctgcttaagcaaaatccgctgatagaactggctaatcacagctttacccatgcccataacaagtataccgacttttataaaaatgctgatgctgtagtccacgattttgacattgccaaagacagcctgaagcttactgataaaatagcaagaactcccggtagaaatatctggaggctgaacaatattaatgtaacggatatcaaaagctctactgcagctgcggacgggctaaaaaaagccggctacaaagtaattggatgggatctggaatggagaccttctcaaaaaatgacgttaaaaggaagtcatgaagccatgatcaagaaagtagacagtattttcttaaacgatcttgagaagacttcaagacaccttgttttccttacccatgaccagtatctgagagatgcagattccatcaacgaactggatctgtttattgaaaaattacagaagagcaacaagtttgttttcagaaaaatttctcagtatcctaaaatcaatgaggtattaaattaagaaacacttcataactgatatcactgaactttgaacattcagagaattttcggacatttgtatttatgagtattaaagagaactataacgcaataaaaaaccagctgccatccactgtgcagctggttgctgtttctaaaacacatccagcatccgccgttcaggaagtttatgatcttggacaaaaagttttcggagaaaataaggttcaggaactgatggaaaaagctccccttcttcctcaggacatccaatggcatctgattggccatttacagaccaacaaagtaaaatatattgccccttttatagatactatacaaagtgtggattctgaaaaagtattggcagaaatcaataaagaagcaggtaaaaataacagaatcattaaagttcttttacaggtaaaaattgcggcggaagaaagcaagttcggacttgacatttcagaagccagagacctgttcgggaaatatagggatgggcagtttcctaatgttgaaattaccggcttaatgggaatggctacattcacggatgatgaacagcaggtacgaaatgagtttttaatcctgaaaggtctttttgatgaattcaatcaattaaaagcattaaatactttatctatgggaatgagtgatgatttcccgatagcgattgaatgcggagctaactctgtgagggttggatctgccatttttggaagaagagactattcaaaatagaatatttaggtatagtttttgctaataattgaaacaaaaaatttaaatttgcaactatgcaaaaaatccttatagtagaagacgaaaaagcaatctcgggagtacttcacagtattctttcggatgaactaaccgattatgaatttgttattgccgaagacggccttgaaggttacaaacaggtagaaaaagaagatttcgcactggtgatttctgatatcaaaatgcctaagctttcaggaacggagcttttgaaacaaagtcttgcattaaaaccagaaactacttttatcatgatctcagggcacgcagacatcgattctgccgtttcctgtttgaaagaaggagcatatgattttatttccaaaccaattgatatcaacaggcttattacaagtgtgaaaaatgcattggtaaaggaaactctgaaaaaagaaaacaagaatcttcagactgaaaataaaaccttaaagaaaaaagtaagcaaaaagtaccagatgatcggtacctctcctgctcttcagaaaattcaggatatgatcgaaaaggtagcagcgtctgacgccagagtactgatcacaggacctaacggtgcgggaaaagaattggtagcccatgctatccacaatcaaagtgagcgtgcaagaggcccaatggtagaagtaaactgcgctgccattccatctgaacttattgaatctgaacttttcggtcatgtaaaaggttcttttacgggtgctattaaggataaacagggaaaatttgaacaggctaacggtggtactattttccttgatgaaattggagatatgagccttatcgctcaggctaaggtattgagagcgctgcaggaaagcaaagtttctcctgtaggaagtgataaagaaattaaagttgacgtaagagtaattgcggcaacgaataaaaatatgcagaaagaaatagaagaagggaaattcagagaagacctttatcacagactttctgtaattgaaatttatgttccgccattggatgaaagaaaggaagatatcaagttattggttgagcactttgcgggaatgattgctgatgagcatggtactgccgcaaagaagtttgacgataaagctattgacgctttaaaagccctttcatggacagggaatatcagggaattaagaaatgttgttgaaagattgattattcttggtggaaatactgtttcagaaagtgacgttgcaagttttgtaaggaaataataagctattatttaccatattataaaaatttgcagtgttaccactgcaaatttttttttacccttatttgaataataaactatatgaatcttaaaatattatgagctttttaaacaaaaactatacgaaggaatgcctgactctggctctgcctgtgatgcttacccaggtagggcaggtttcagtaaacttattcgataatattattgtcggaaaattattgggtgccgatgcgctggcatccgtttcattgggaaatgctgtatttttctccatatttgtattggcccttggattttcatttgccatcccgccgctggtttcggaggcacactccagagaagatcatgctacgatcaactctgtgttcagccacggttttatcatcaatatgtctgtcgggattattctgatggccatcttactgctgggaatgccactgctctatcattcagggcagcctgccaagattattcctgatacagtaagcttcttaagcatcatggtgatcagtatgattccatttatggcatttcagacgcttcgtgaagtatctgaaggactatcatacacgattggggttacaaaagcaaccattattgccaatattatcaatattgccttaaactatgtttttatcaaaggcctttggggaattccgccgatgggtgtaaaaggatctgccctggcaacactgatttccagaattttcatggtggttttcctttattttgtattgcttaaagaaaagagaacaagacgttatattaaagatttttctttaaaaattcagggcttttcaaaacagatgtttgataaaatggtgaaacttggactgcctacagctttacagatgttttttgaagtaacggctttcgccggagcagcatttatctgcgggttgatttctgcgcacgatattgcttctcaccagattgctctaagcatggcttctttcacctttaacctgtgtgttgggttcagtgtggcctctacggtaatgatcggaagaaagctgggagagcagaactttgttgagctgagaaaagtaggaatcaacaacctgaagatcgcctttattttcatgtgcatttgcgggttggtctttattttaggcagaaatatacttccgactttctttacgaaaaaagaagaagtggaagttattgccctggctgcaaaattgatgattatagcagcgttgttccaactttctgacggaatccaggtaacagctctgggaatgctgagaggactacaagacgttaaaataccgtctatttatacctttattgcctattgggtgattacaattccattgggatatttcttctgtgtttccttaaaaatgggtgcattcggaatgtggatcgcactgggactaggactgacagtatctgcagttttcctcgtaaaacgatttttaaacatgtccgcaaaacgaattaagcagaatatgcagacaaaagcacaataaaactaagcgcagatgtaaaaaatctgcgctttttcattatttttggtgtcgataaccatcaatagaaatgaaaaaaacactgatcttccttgccttatatgcaggttcttttttccaatcccaaactaacagatttacttacgaacttcagtaccgcaaaaatccatcacagcaatatttaataacccttatgaatctggatatcagtcccgggtctgttaaattttatgataaaggctttgctgattatcatgaaaaaaataaacatgcaaatcagcagatttcccggtacagtacgaaaacagatcaggtggtggaaagaaaaccggattcttttaaaaataactggtacagagatttttttgattattttgtagtaaaaacaaatgatgaaatgaagtggcagatcattcaggagaccaaagaatacaatgggtataagcttcagaaagccagtacagatttcggaggcagaacatggaacgcctggttttccaacgaagtgaatatacaggaaggtccttataaattcagaggtcttcccggtctcatctttatcttagaagacacggatcaaaactttgtctataaactgattaataatgaaaaactaactacagactacgatacccaagattttgtagaaacgcattacggcaaaccggctatccagataaccaatgagaaatttaataaatacattgaggacatctaccaaaatcctacaagaatgttctccgagagaataaagagcggagaaaagagtaactttaaaaatgaaacgatagaatctgtagaagaactcaataaaaaaaaggaaatgctccaaaacggaatcaagggccgttatatctatattgaaaaagataaacaacctgaattcaactgatacaaataaagcggcccccagccgcttttatatttaactaattcttcttcccaatatgaccaggcttctttctattccatccaaaacagcaacattcggaagatttccccaatcttcaaatccgaaatgcctgaagagctttaagctgggttcattgtgaaggaaaataagggcaaccagattaagcactccaaatttctccgcgttatcaatacaatactgtagaatcgttttaccatatccttttcctctgcaggactcatccagataaatgcttacctctaccgtacccttgtatgctgctctttcatggaatgaactgaagcttacccatccgataacatgattctgttcatcttcaactacccaaagcggtcttgtctgaggattatgctcttcaaaccattttagcttgctttccacagaaacttcttccatgtctgcggtgaccatccttgaggcaattgttgaattataaatggctacgattttgttcaaatctgacaattcagcattcctgaactttaatttttccatggatgaatattcgacttaatttcacacaaaaatactaaatttcaaacacaacccctgtagattcacaaatggattattcaatttcgttgtttaccaaagttcacccctaaaaaatatacatcaattcaatcttatgggcacttaacaatttcatttttattgtgaaaaattattttaagtcttttaagattctattcagacttcttactgtaattcccaggtaagcggccatatcttcttttgaaatctgaattccttctttggcctgcattttcagtaattgtgttaaagtatgctctgttgtataaagctgttgataagatgccctgctggaagtattgataattcgttccgcaaaaatatccagcaataaattatttaaagcaatatcatttttaagcaaaaatctgaaatacggaatggcaatctcataaacagaaacttcagttagtgtttcgatactgcataagcatggtgtatttttgatcatctctatttctccgataatttcaccgcttccggaaaactctacaatatattcttttccgttttcttccgtaaaatagcatttggtaattccttccttaataatcataggtttgagaataaactgcccttgtaccagaatctgctctcccctgggataagttttcaacagaatatctctgccactctcctgtttatgataaagcgcttcaaaatagcttaaaaaggtctgattggtgcgtaacatattgatccgggacaaatgtcctttgcttgttgggtttttatactgaattttgagatcagaaaattacaaaacaaaaatgaataatcatatcacaaccattgcatttgatgctgatgataccctttggatcaatgaaccgtattttcaggaagcggaaaaagagttttgcatgctgctcgaaaattaccttccacagcattctgtatcacaggaattatttaaaacagaaatgcagaatcttcatttatatggttatggggtaaaaggttttatgctgtgcatgattgaaaccatcagcagagtttccaataatacggcgccattggaactggttaataaagccatacaattaggacaggaacagcttcagaaacccattgaactattggatggagttacagaaactcttgaaagtttaaaaggaaaatacaggcttgttgtagccaccaaaggagatcttctggatcaggaacggaaactgaaaaaatcaggattacaggagtatttccatcacatagaaattatgagtgataaaaaggagcatgattataaaaagcttttgaagcaccttgactgcaaacctgaaaattttatgatgcttggaaattctattaaatcagatgttttgccggtgttggaaatcggaggttttgcagctcacatcccttatcatgtcacatggagccatgaacagcatgatgttaatctggaacatccgaattttatggagcttaagagtgttgatgagattctgaaatatctttaatcttaggccattaagatttattaaaaaaagagactgtttatgataaacagtctctttcgtaatttatttcttcagacacttttcaaggaactgatcctgttcccatagaaggtgtaagatattttcttttgcctggtatccgtgggcttcttttggaagaaggaccatttttacaggagcacccagatttttcaatgcctggaagtatctttcagtctgtaaagtgaaagttcccggattgttatctgcatcaccatgtatcagaagaagcggagtcttcattttatctgcatgcataaacggagacatcgtattgtaaatttccggaacatcccagtaatttctctgctcactctggaatccaaaaggtgtcagcgttctgttataagcaccacttcttgcaattccgcatgcaaaaagatcagaatgggtcagaaggtttgccgtcataaaagcaccgtatgaatgtcctcctacagccactttctttctgtcaatatacccaagatgatccacagcatcaatggctgctgctgcatttgctaccaattgcggaataaacgtatcattcggttccgtttttccttcaccaataatagggaaagcagcatcatcaagtacagcatatcctttcgtggtccagtatacgaaagatccgtaatatgggaatgtgaattcattagggttttgggtgttctgccctgctgtatttttatctttatattctgtcggataagcccagatcagtaaaggaagtttttcttttttcgcttttctgtcgtaattagcgggaagataaagagttcctgttaaagtaacaccatcatttcttttataagtaattacttctttgtaaacgtctttgatactttcaaaagggtttgcaaagttggttacagcttccgctttatttgatttaatattctttttaaaataattcggatactggcttggagactgctgagtggttaaaatctcaccttttgaaggattcagaatatctacgatagtctcttttgcatttttaaggttagaagtataaagccttttcttcttcaatgatttaacatccatttcatctatgaacgggtgctgaccatctttggtaaatccatctcctatcaggtaagcttttccgcctttcatatccactacatatctcccgtattggttttttgtagtgttaaagttcccgggatcgctgtaaacatcctgataatttctgtcatcaaaaactttagattctccgttagtaagatctatcagatacgattttgtatttcttgtatcgtaccagccttcagaaacaatggcataatggtcatttgtccagactacatcttcatatctctgctttgttttaaagaaagatttcggagctgcagtaaaaggtgcttcccatgtaaatatctcatctctgtaatctgcggttttagactgatcacctccgtccagagcttcagcataggtaagagttgcgggagcatcatttcgccatgtcatatctctctttccggttcttactgatgaaaatcctttcggcatgatttcattcaaaggaacttcattcactgtttttacagcatttcctttcatatcatatacaatcgttactgatgggaatctgctaagcggaacgatataggaaaaaggttttttaattacggtagccatcaggtaatttccgtcaggagaaaaacttaagcctgcaaacatatcctgatctttgaatttcttaagatttcctgtaaggtctacattatagagttcagaagcagtaagtgtttcaaagtttttttcgtcctgaggatttttcagaagatcctggtatgttctgttttgggaaactttaccatcagccgttgaaacaatcgggcctgtaggaagatctttggctgcatctataagggccggtctgttttgcggaagtgttctgatcagaaagctttgagaatcattataccatagataaggcattcctaaattggcattcagattatcagctgtaattttttttgcagcagcggtttccatatctacaatccaaagctctacgcctttattggttgtattggtaaaagcgagtttcttttcatccggagaaaacgaaacgtatgcaattttcggattggaaggcagattttttacctgaatctcatttttatcattgatctttctgatcttcagattatttgagtaggtcatgctgcttgagatattggtaaccggattgattctgagtccgccaagcttcatttcattctggctcagatcttccagtgttttatatgttggacgatacgtaaaaactacccagtcttttttgctgttcatcagaacaactggtggcctttcatagtctgcaagctttaaaatctcggcagaaggtttctggtacgtaatattttcctgtgcatcgtaaaaattgagaaatgccagaaggcaaatagtcagttttatcttcatataattcattttctacgaatgtagtgaatttcaccggaactggcgccctatctgaaagagtttactgctattatatctttaaaaagagaaagcacttcaaatgaagtgcctttctttatttgtattgctttatcctttaaattaccagtctgaagctctttttcttttttctatcatatgatctacggaaacttttccggctcctattaccatgagcagaagataaacagacagatagaccagtgccaactctcttttttcaaaaggatctgcaccatgtactataaaacctgcaatgatcatggtaaaaatcaggaatcccagagcaactcttgtaaaaagtcctaatataagtagtattgaacagacaaattcagcaaaaaccgtaagaattagcgatatctgtggccccagtcccataaaatcgaaaaactcgattttaccaccttccaatagcatctgaagctttggaaaaccatgataaagcattgcaaaaccaacaaataccctcaccaccaataaaacaatatctttaggtattgagcctgaatttgaattattatagttcatctactaaaaaatttatactaaggtaataaaaatcttttaatataacgggattccggccgttttagtttatctgtaaccgaaatttttgagatccctgtcattctttctccagtcttttttcacttttacaaataagtttaaatggatttttttagtaaagaatttttcaaggtccaatcttgcttcagttcctacttttttgatagcttcccctttgtgaccgataatgattcctttctgggtatctctttctacataaataatagaatcaataaagataattccttctttctccttgaactgctctgtaaccacttctacagagtatggaatctctttatcataattcagaagaattttctcacggatggtctcattaacaaaaaacctttcaggcttgtctgtgaactgatctttatcgtagtaaggaggattctcgggaagtaacgattttattttaggaagaatcacttctgtattgaaagcattcaaagcagaaataggcagaatttccgcctttgggattctgttgtgccactcttccaccaatttttcaagacctgcctgatccgtctgatctactttattcagcagaagaaggacaggtacaggaattttattcagtttctcaattaaaaattctgacggttctgctttatcggtaacatctacaataaacaggaaaacatcagcatcctgcagagagtcttttacaaagtccatcattttttcctgcagcccgtattttgggtccaatactcctggagtatcagaaaatacgatctgaagatcatcttcattataaataccaaaaattctgtgacgggttgtctgcgctttctgcgttacaatcgctagcttttcacccattaattggttaagcaaggtcgattttccggcattgggctttccaactatatttacaaatccagctttgtgcataaaaataatattacgaactgcaaagttagtaaaacaaaatcggtctttacagtttatctcaatatttagaagaaaaaagagagttatataaccttaagtggctgtaataaaagaaattttaaaaataaatacaaaaacggatattttgcaaggttaaaaaatatccgattattttgtattgcattacctaaaactgatatttttgaaaattagaattcatctttatgaatatagaccagattcttgatcagatttaccttcttcctgaagcatcaaaaaacagtttaaaaaagcatatcactgaagtttcgcatcctaaaggtttctgcctgatggaagcagataaagtggttccctatctgtattttatcaggaaaggaattgcacgtgcctattcttcaacgtctgaaaatgatatcacattctggtttggaagcgaaggccaatgtatattatctatgaaaagctatgtagaggataagcccggctatgaaagtatagaacttctggaagactgcgatttgtacagaatggaaacggagaacctcaaaaaactctttaatgaggatattcatatcgctaactggggacgaaaactggcagaagctgaaatgatcaaatccgaggagctgatcatttccagacagttcaaaacctctttggaacgttataaggatattatgacctatcagcctgaattgcttaagagagttcagctgggttatattgcttcttatcttggaattacccaggtaagtttgagcagaataagggcggagataaaataatttttgattttgaggatggaagctggaggatggaagaaggaagttatgatagtccactaaggaatcctgctcatttttagtaattaatgcttctaagaactttatctaaaaaatgtttgctaattatcttatgagacaataacttcaagcttgccttcattttttaacaattgtaaaattttttctgcctccaaattctgaactttgcagtagaaaaatttaaaaaatgaattggattatattaattgtagccgggttatttgaagtcgcgtttgcatcgtgtctgggaaaagcaaaagaaacttctggaacagaatcctattactggtttgccggttttctggtaacaatgactatcagtatgcttttactgattaaagcaacccagactttacctatcgggacagcttatgcggtctggacgggtatcggagcggtgggaactgctttaatgggaattatcttctttaaagatcctgtaagtttttggagaatattctttattgtaacccttattggttctgtagtaggtttaaaagcggtgtcttcatcacactaaaagcgcataacttctatcaatatttaaaaacaaaaaccgtcttcataacagagacggtttttttgtttatttcaaatcttcattttaattatactgtcaaaacagataaagaagaaattctttatatctttaccggaaacttttaacctatgaaaaaaattctattccttttagcaggtggtttactgactgcccagcaaacttctgaactcctttccaataattggtatatttccaaaatggtgaccagtagcggccagaccaccaatacccctttaatagataacggagttcctgctaccacattcaattcagtgggaggtacaagctatgttattaattccagatattacaatacatccatgatgagttttggagttatgcctggaagtaacaatcttatcaaaacggccagctcgtgtactcttttgttttataatggcggaaatgcatcagctgttcgtgcctacgatcagaaaaactgtgacacttacgtttcaggagcttatgcatctatatacagctatcagattattacaaacggtaacctcaaaacactgataattacagatccttcaggaaataaagtctattataacaatacgacccaacttaatactaaagaaattgatgccgttgcaaaaacgtttaaagcatatccaaatccggtaaaagagatgttacatattgaaaatattgagagaaatcttcggcttaagatttatgatctctctggaaaactggtatttgaaactataacgagtggtgttaatatttccattgacacaagcagttttcaaaaaggacagtatattttagttcttgaaaattataaatcttatccttttacgaaagagtaacagaaaataaaacccgtcttcaacaattgaaaacgggttttatttattttttataaactacaggtaagatctcattatgtctcagcccatatttttttatttcttcttcagagaatttctgtgagtaaaaattaggttctgtttcaaagcctgcttttcttaagcggtcaaaataatccattccataccagcggacgtgatcgtattgcccgaagtgcttctggcgttccttaggatctttaatggtaaaatcttcataggttttctccagtgaatttttcatcggaacctgaagaattccccatccaccgggctttaataccctgtacagttcgctcattgcttttgcatcatcttctatatgttccagcacgtggttacagaacacaatatcaaagctttcattttcaaacggaaggtccagaatatcagcctttacatctacaatcggagaatataaatctgctgagatatagttaagattgctcattcttttgaacttccttaaaaactcctgttcaggagcaatatgcagaactttataatttttaatgaaaaaatcagtttcattctgaagatagagccacatctggcggtgtctttccaaacttaaagttcctggggaaagagcattttcacgctgcttaccgtatccgtacggaaggaattttctgtaagatcttccatcaatagggtctaaaaactgatctcctttgaaaaactgataaataagcggccttgcccagatgctcattttaataagcatcggacgtggaattttattcagtaaaagcttcgttaattttttcattaaaaatcaagttggaactgcttttcttcatcacttacaatccctaaagcttcatatacatattcaaatgttgaaagtaataccggcttaccgttgattaccgctacgtcatgttcgaagtgagcggatggcatattatctaaagtagtaaccgtccagccgtcattatggaatttcactttttcggttcccatattaaccatcggttcgatagcaatggcaagaccgtctttaattacttttccgcttccttgtcttccgtagttaggaacctgtggatcttcatgcatttttcgtcctaaaccgtgtcctacaagttctcttaccactccgtacccttctttttcacagtgtgcctggattgcgtgggagatatctcctattcttttccctctgatacactgctcaatccccttatatagagattccttggttacctgcagtaattttttaacttccggctttacttccccgatttcaaaagtataggcatgatctccaacaaaaccgttaagaataactccacagtctactgaaagaacgtctccttcttttacgacatcgttgtttggaaagccatgaaccacctgctcattcggagagatacaaagagaattcgggaatcctccataccctaaaaatgcaggttcagcaccatgatctttaataaaatcatgagccagtttatctaaatataaggttgtaattcccggtttaatttcttttgccaacattcccaatgttttagaaaccaaacgggcactctccttcatcagacgtaattcgtctatcgtttttaattgaatcattgtatatagatgttagatattagatgttagaagctacactacagcgttatgcttatttttacttcccgtcatctactgaactttctactataaattataaaagaccaaaagcacttgatattaaaaactaatgtctgatatctggcttccaatttttatattctaccaaaaaagtccttttttcttttcttttttaagttttgaataggcaagaacttcttttccttctacacggaattctattctttcctgaataatgttatagatttcaccccagcccgggaatcctcctaagtttctgtcatcaataaaccaatctgcatctaattttctggactgtgtttcaggatcaaaaatctctccttcaaagcttgaattcacagaatagaactctattccgttttttctgcagaattctacagcttcatccaacgtttttccgtgtctgtatgtccaaagtataagtctgtatccttcagcctgaagtctttttaaagtttcgaatgcaaaagttttcggttttccgattgccgggtaggcatcatcaacaatagtcccgtcaaagtcaacagcaatctttttattatttaacattttgttgttttttttagctttgcaaagataagaaataaaaagagtgccaaaaagaaaggcactcaatactttttatatttaaataataataaacttcttatcagctctttacccagctaaactggaactgaagatccggagtagaaaccctgtctgtgatcttctgaagtcttgcaggaagcttcatcaggtattcctgagctttttctgctttttctgtaaggccttttacgtgctcaattttccattcatccaaaaggtctttcataatattgatataatcctgtcctgtatataccatacatctttgagcagcatctgagaaatgtccccaaagctctccagctttttgtccggactgtctcattaggtgggcaggcattacaattttcttacgcatcatatcttcaaacgcaagaatcatttccgaaggatctatttcaagaatttttgctacaaaatgcttatatgctttagcatgtctggcttcatctgcagcaataacaccacacatttttgccagttttccgttaccggattgttttgccagcgttcctacccttctgtgggagatattcgttgctgtttcctgaaagcttgtataaatgaagtttctgtacggatccatgcttgttcccagatcaaaaccgtcgttgataaggtattgggtagtaatctcaacctctctcatatttactcttccgcacaggtaaagatatttgtttaataaatctccgtgtctgttttcctcagcggtccaggctcttacccagttggcccagcctactttttcttcctgattgattccgtcaacacccatcagccatgactcataggaaggaagagcttcttctgtaatacagtcaccgattaatgttacgaaaagatcgtaaggcatttcacgggcaaatgtctggatttcttctaaatcatgtttaaaatcttcgcttgacggatctggcaaataatcggagggttgccaaattttttcaattggcgttaaaaatttatcaagaaaagaagtcacttccttttccaatatccccattacttctttccttacaagcttttgatacattttactattcagttttaatttacaaagatatgatttatttattatttggcgcataataaagtatgcaagtcataccttatctgacataaatcataaaaaaaatgccgttataaaggtataacggcatttttattcggatattattgaattttaattaaccaaaacttctccggtcatagcatccggtatttccactcccattactttaagtatggtaggagctacatcgcctagttttccaggttttaaattccatgtgtggtctttatccatcacgataaaaggaaccaggttcgttgagtgctgcgtatttggagttccgtcaggattgatcataacatctgaatttccatgatcggcaaggatgaaaacagcataaccgttttcataggcagctgttgctactttttcaatacactgatctaccacttcagcggcttttactgctgcttcaaagacacctgtatgtcctaccatgtctgtattggcaaaattcaggcatacaaaatcagcggtcccctgctccagttcaggtacaattgcattggtaatatcgtatgcggacatttccggttttaaatcataagtaggaacatctttcgggcttgggcacaacagtcttctttctcccacaaattcctcttctcttcctcctgagaagaaaaaagtaacgtgaggatatttctctgtttctgcaattctgatctgagttttcccatttttctcaaggatttcacccatagtttccgtcagtacattttcatcaaaaactacctgtacattctggaaggttttatcatagttcgttaatgtaatataatacaggttcagtttcttcattccaaactcagggaaatccttttgagaaagaacttctgtaatttctcttcctctgtctgtacggaaattaaaacagatcaccacatcatcttcaatgattcttgctaccggcactacatttcccgtagcggtagtgttcattaaaatgattggtttcaggaactcatcggttacattattatcataatacattttaatggttgccagaacatccgttgtctgttctcctattccttctacaagggctccgtacgctaatttcacacgttcccatcttttatctctgtccatcgcatagtatcttcctaccactgttgccagctttccggtagtagcttccatatgcttctgaagttcatcaataaatcctaatccggaatgcggatcacaatctctgccatcggtaaaagcatgaacaaatacattttcatttaaaccgaattcttttgcagccgtcagtaatcctttcaggtgattgatatgtgagtgtactcctccattggaaaccaatccgataaagtgtacttttttattttctttttttgcgtagtcaaaggcgtcctgaatcactttttcctgtcccagtgttccgttctcaaccgccatgttcagttttaccaggttttggtatactactcttccggcacccaggttcatgtgtcctacttcagagttccccatctgcccggccggtaagcctacagccagtccactcgcttcaagcgttgtatgtggaaatttttggtaacagctgtctatgaatggtgtatttgctttatctattgcagaaacgtttgggtttgttcccaatccccatccgtcaagaatggccagtattgcttttttcgacatgttgtaaaaacttttgttatacaaatttacctaatttcctatgaatagaagaatttgaagtcctgaattttatgtattcgcgataaacaggaacctcaacagacaaatgaattcttgaattcactatctcgtttatcttaaagtttattctttaaaaaagtcttcgaatttggtattattctgctttgtatattctctgatgtattgatctaaaaagccactctcttttaaaaacaaaagcggattctgaatatgtaagatatcataaatagctttatgcttatctgattgtttattaaaatacgcctcagaaattttataccccatccaatacccaagatcattaggacgatcatcttttttggtagttccataaagccagtcagtaggatctttcttctttaatacagttacaaattctttatacagtttatcagcatgggcctctccatatggataaaatgggctgttattggtttcgcccgacaccaattcgctgataaaatcagcacttccttcacttaaactatattttaacaagttatcggttcctttaatatcctgttgaaaatgtatcatttcatgggaaacaagtcctgtaatgccgtccagattctgaagagtttcggtgccaatcataattccgtctttagaaaatgttcctcccgtattaaaccttccgtatacaaaatatataggcggaaattttgcctgcggataccaatatttcaatgcgctgtaaacagctctgatccttctttctttttggctgattcctgccagaacattacggcttttcagataatcttcttttctcttcctgaccattgtatataaagaatcagcattgattatccggtattccatgaaaccttttacaccttgagatccgctgctgatataatctgtaaagggattttctttcgaagtatccatcttttcgaatgctttccagaaacggtctgtgtctcttgtttcaaatactgcgttcaatggatcagtggagaagtttgtctgggcttttgtcattgcggaagctaaaagaagaactgtaaaaatgtatctggttttcatattagtttttaaagatttcttatcaaacggttaaaaatataaaaacttatatagaatcaaaataaagcctgtaaaagttttaacagggttgaaaaaactggaatttcgttgattatttcaattcattatcattaaatctttttaattttgcagtatggatttacgagatcaattgaagaatctttttcctgatcatgaagagcaggattttgagatgcctgaagaagaattcaagcagaaagagcctttggtatgcaaatttgagaaaaaaggaagaaacggcaagcccgtaacgattgttgaaggttgggaaggtagtgaggaagacctgaaaaaaatctcaaagaaaataaaaaccaccttaggtataggcggctctgagaaggatggaacgattatcattcagggggataaccgtgataaaataatgaatatccttaaagaaatgggatataaaaccaaacgtgttggcggatagttctagaaatagatctgggtttccggcagtaaggtttttaaattttcaacagtagatttttctataggatttcctgtaagaatcaatgttttcaggtttttgagctgtttgatttctacaggaatatctttcagattgttattggccagattcatactgacaatatttttcagtccttttactttgggtgatatttctgtgatatgatttccgcttacattcagaaattcaagattctttgctttgaaaagattctcaggaagtttgatgatagcgttctgctgaagttcaagatattttaaattttcaggaaaagacaaatttccaaggtcattgatctggttatctgaaagattgagaaacttcagatttttgatccgatccaatttgtctgcaataaagctgatctggtttccctgaaggttgatttcttcaagtgcgggaatttccataagagcttcaggaaaggtattaaggttattggcatcaaaatgtaccactttcaggttctgaagctttgcaagattaggattaatgcttgtaaggctattcagattcatagaaaaagtattcagtttcttcagattgcttacctcatcaggaatatatttaatgctgttttcattcacatttaaaatttccagttcttttaaagcaaagatttcctgatccattttctcaagcttattcgccataatatttaaaaagaataatgaatccagttttacaatctgaggaggaaggttgaacaatcctttttgtctgaaacttatactatagacagcctttttacttcttaaagcctcttcaatattggtaaaagtaggatacttcaccggatcaatctgtgctttgatctgagaaagtgaaactatggaaatcagtatgacaagctttttcataaaaataaaaaggtctgccggcaaccgtggccgccgacagacaagaattataaataatttatttctttacaagtttaactgttttctgaaatcctccttcagcttcaatatttaaaaccaaaactcgtgatccttccaactgctgtgtgaaatcaaggtccaatactttgttggttccgttgaatttcttcgtgtaaacgattttcccatccatgctgtaagctgtcacagcaatatctttcaatccttttgctgaattgatttttaccattcctgaagttgggtttggcgctaccgttactgtgttctcttcaattttagtatcaatagttcctaaagttccttcagttcccagattatttttaagagcaataacaatcgttgctgattttcctttataatcaatcgtatttcctgttgcatctacgtctgtagagatcgttgaatccggatgctgaatagagaagaaaccgaatttatgatcaggcgtaaatgtaagtcctgtaggttctgcacctgccggcattgatgcgaatagtcttactttaggattggcttgtgtatgatccggagcaattacccagatgtagtttttacctccatcctgaagcacccaaaggtttccaagctcatcaaaggtaagattgtcatttccatcagcccatacttcagatttcactccctgagctgtattgaaagaatacactgtagatcctccacctacgaaagtttctacctgggaagcagtagtcccgttatcctgtaaacggtatactctgtctaaaccttttgatgtaaaataaattttcccatccagcgggctgatatccacatcttcaataccattaaactttgttcctcctaaagaaagagctaacggacctgtattgttctgatctgctttttctttattcggaacctggatccatgttgctgttgttgctgccggatctcctgcagccgttaatccctggtctaatttcagtacataaaggtttcctgaagaaagatcatttggcgtatccattacatatttgtagaccatgtgagttccaccgtcttctccataatatgcgattgttccggcattattgatgaccacattctcatggttcatgattcccatctgccatagtttacctttggaaccgtcagtatttttagaaattacctgtgccgttgcagggtcaatttccactaaccagccgtaatctttgtacccatcattgttcacgtcgttggaagtaacagattcttctgctgttaccacagttccccatggcgtaattcctccggaacagtttctgatggtttgtaccagacttggagctgagaagcttaccgctcttgattttgtaagctgccaaagctttgaagttgcattatagctgatttctgccatagtaactcctccaggattcgtttcgtggtttacagacagatatccgtttgtactgcttcctgcttttgcaacataagctgtgaaatcgttctgacctcctaccaatcctccgccttcggtataattgtcaccttcttttaagataagctggtatttgtgctcagcagggataattaatttattggtttgtgctgtaggaacaatagaggtaaagcagctgatatgagttccgttacaagttacaggtgtagtggtattggcagttgttttcagataagcatcaattcttaaatctgaactggttgtgcttctgttatgcagctcaatagaaaatctgttgacaccgtttacaaattttgatttcggaatggagaagatattataaacgctttctgccgcaccgtcaatagtagtactggagaaagtattgaatgtaacagcgcctgcaggcatattatctcttaccacttcttctccgttaaggtatacaataataccgtcgtctctcattacaccaagttccatagtatcggaaagtgtggaaagatctaccgtaaaatctttagcaaaataagctgttgtaagtccggaattgattgtagtggttacaggatctccatatcctagcggcccgtttcctaccgcccaggttgaaatatcatagttctgggtattccatcctgccggctgagcctggttgttatctttgtagctccatgatgcattcttattgaatatcatagtctgcgcctggaggccagaaccggccaatatagccaaagttcccactgttagtagttttttcttcattttctatttgatttattagaccttgcaaaactatttttttagaacttttactctgttaataggattttaaatatggatcggtaaatattaacttatcaaaaacccaatgttaaggggattaattttgtgttaaatggtgagggactttgggttggagagttttagggttgtagggttgaagttgcgggttggaggatttggaattcaaatgtgtacggacaattattcatatcataatggacatgtatatttatcctatttattgattagctcaaaacagctatgttcaacaatctaaacagtaaaagaagagaattttttattcaaaaatgtgaatattttagaagataatttattttaaaaacgaggtctattcttatctcttaaaactttatatttgttattatgattgacacagctatgcaaaataaaaaaatacatcagggcagaaatattaaacgtttccgtgaaatgctgggtatcaagcaggaagccttagctttcgaactaggtgatgactggaatcagaagaaaatctctcttttggaacaaaaagaaactgtggaatctggtattttagcacaggttgctcaaattcttaaagttccggcagaagcgattgagaattttgatgaggaatcagcaattaatatcattgcaaatacatttaataatcatgatcattcttcacctcaatttgctacaattattaataattcaccaagcttccaccctcttgacaaaatggttgaactttatgaacgtatgctaaaacaacagcaggaaatgattgataagctggaaaagctgattcaagacaaataaaataaacttttttattatctctcaagattttatatttgttattatgattgacacagctatgcaaaataaaaaaatacatcaaggcagaaatattaaacgtttccgtgaaatgctgggtatcaagcaggaagccttagctttcgaattaggtgatgactggaatcagaagaaaatctctcttttggaacaaaaagaaactgtggagtctgatattttagcacaggttgctcaaattcttaaagttccggcagaagcgattgaaaattttgatgaagaacaggcagtaaatattatctcaaatactttcacaagtaatgatgcctcaacgttaaatgcagtaaatattcaacctaccttcaatcctcttgacaaaatggttgaactgtatgagcgtatgctaaaacaacagcaggaaatgattgataagctggaaaagctgattcaaaacaaataaacagacagacagatccgttctgaaaaactttaggctaaattctgaaacatgcgtagataacatttacacaagtttcaaaatttagcttatttttattaaaaccatatcattcctaccgaatctctaccctccaactctaaaactctaaaactctaaaaccctccaactctctcaccccgcgccccgtctatttcgctttacttacatccgtaagagcattcagaaaggcaatgatctgtttcttttctgcttcagtaaggtttaatttatccggtgccagcgtctgatttttcatttttaatcctaatccttctcctcctccttcgttgtaaaaatcgagaacttcttccagagtatcgaaagctccgttatggaaataaggtttcgtaagggcaatatttcttactgttaccgttttgaaagagtaatcataaatccatgatttttcctttttcaccgggctgtttcctcttcccaaatcctgatcaagctgtacgggaagctggctgataggttttgtggtaattcccaggacttcagattcattttcattaaaaaacggcggaaccaatccagaaaaatgaggcgcaaaatgacaggttgcacaattggcttttcccataaacaggttgaaaccttttttcacatcctcagaaacagtcttttcattcctcataaaacggtcaaaatcactgtcaaatgaatacaatgaagctacataagaacttaatgcttttgaaaaattttctttgctgatttttccgtctttgaaagccgcgcggaaggcctttttatactcaggctttgttttcagcttctgaataatgctttcgtagctcgtattgaattcctgttcattataaataacgtgttctgcctgctgttcaagataaaaagcacggaggtcatagaaaaatctcttggcaaaaacagcattatataaagatggcgaatttctcaacactgtttttccttccacattgctttgcgatttgggtttcaggtctgtaaaagcattttccggaaggtggcatgtggcacagctcattttcccgttaccgcttaagttctgatcatagaaaatcgattttccgaggtttcggagttccggattattttcagaagatttcagtaaggtataaaagtacggatctaaaaaatcactgctgaaaaagtttttattacctacattccagcctgaaaattccttcagatcgtctggtcttccgtcccattttccaagttcttcgtacaaaggctgtatgtattttttgtaaaactcaatcctgtcaaagctttcaaagtcagtattttttgaaagatagcttattccgtctgttaaaatctggtcagccctttcaatattataatttttaaaataaggatcatcattgatgtatttctgcattccggaaaaagcgtggcttgtttcttcggaaatattcagggaacctggtgtatcaaaaccggacactcccagtgaatagatcctgatcagttctatacgcaaaggcaatgttttgttgtttcctgtgctcaacccattttttaaagcgcttaaataaaacccggaatagctgttatacaaaaaagtagttatggtttttatcttttctttctcatttcctgcttcgtctgaaaatatcagttcatccagcacctgcaatccttcgggaggaagtgtataggcagatgttcctgcagcttcaatatgaaacaaaggagctgcgttaaggtggctttttgtaaattcaggataatggtaagcaatataaaattctatttccttgaatgaatttcttgtactgctgagtgttttctgtaattcttcgagtgaaatccggtcttcagagaacttatcaacatctgacttcaactgttcaagcttcattttaaagtcggtcaaacctttattgacaaatgtattttcgcttctttttccttgataaacaggattaaaagacattactgcaaaccctatgagaagggcaattacaagcagtggataagatctcatgaatttttagcggcaaaactattcatctgatgttatctgagttttaataagagattaaataatgtttatatttctgatacaatatttttcactaattttaaaccccgaaatcaaattcattattctaaggaaaacggtttttcaacataccggtaaataatggcggaagattattgggagaggattttttaaattaaatcaacacatcaaaaaaactaaaataaaagtatgaaaacaaaactatggtttgctgttgcaacaagtttcctttctctgaccgcgttttcacaaaagaaaaagcaacaggaaaaacaacctgaaaagaaacaggaaatggctgtgtatgctgagaaaaaaggaagtgactattatctgatacgtcttgaaaataataaagaaattcctaatgtatatgtgtattccaatggagttacaaagccctataaaacctatactgatctttcagatatcctcagggattttccgggaatgatgacttccaataattcaacaaaagaagagcttgtatctgttctgaaaaaagatgatcatttctatgaaattacgtcacagaggaaagatcctaaaaacattgaaaaaaccgttgttaccgtatatgaggtaatgaacggccagaaaagaattgtagaagaatacaatgacatctacgaggttatggcatctccttataaagaagccattatgactaattaaaaaacaaaaaatatacatattatgctaaacaaacttgctgcctcagaacttgttatgaatgaagacggaagtgtataccacctgaatcttttacctgaagatattgctgacaaaatcatccttgtgggtgatcctgacagagtggcaaaagtttcaaaatattttgatacggtagaaatcaagaaaaataaaagagaattttatacgcatacaggaacgcttcgcggagaaagaattactgtaatgtctacgggtatcgggactgaaaacatcgatatcgtgatgaacgaacttgatgctttggtaaacatcgatcttaaaaataaagagttcaaaactgagcacaaagcccttgagttattccgtatgggaacctgcggaagtgtaaaccctgatgtacaggttgacaatatgcttgtaactcaaaatgtagttggtttagacggattaatgcatttctatcaggattacaactttgaaaatgaattttccaaaagcttcctggaaaaattcccttatgaaagaatcaagccgatgctttacttctcagactgggcagaagaaatgggagaatactacaaagatgccaaataccatggaaatacggcaacattcccgggattctatgctccacaagggagacagcttcgtttgaaagcagtagatgatcaattccttgaaacattgaatgatcttggaattaccaatttcgaaatggaaacctctgccatctatgcgctttcaaaattattaggacacaaagccatcactgtaaataacgttattgccaacagaagacgcggagaattctctgcagatcatcatgcttctgagaaaaacctcattgaatgggtattagaaagaattattaagtaattatttaatttattatacaaaaaaaacctccggaaaatgtttccggaggttttttattaggttttggttaaagccgatgttttttatttattggaaaacgggctaaagcccgttcctattgaatttgtattgtaggatcttgttcatttcacgatgaataaaataccacccagtctgtcattccgtaggaatctctatgctgtttttaatgtttatatttagattcctacggaatgataaagttaccaaaagaaaaatagattaagaactgatgatcaatgatacaaatgccataatcacaaatgaaaagttctaggatccggatattgaaatgtatagcccagttctgaaaccagttttgaagacagaaccttcttccctttcatctcaaattcttcttcatccggaatatctttctgtgcattgatcacctgactttttgcaggatgaactggagctgtcacattatatagttttgattcagttttctgttcaatcatttctgagataatcccgctgatatcagcataatgaatatgattcaccgcatgatcaaggttaccgacattataattttttaaaagcctgttgtctcccatgagaccaccaagtctcagaatattcagttgaggatatttattcctaagcattctttcccctgatactttctcaaaaggaacatcttcttctgtgaattctttagctatatcaggataaacacctgtagagctcatcataaacatctgccctttaaaatctccgataaaggctgacaaattctgaatcctgttatataaagaacttacacagcagcttttctcagaaacagggatggtaatgatcaaaacatccatatctttaatttcttcccaccgggaaacaggttcagacaattgataatccgggaaagatgctactatggcattgatgcctttagaatgtagtgtgtgcactttatcctctgtagttgtcgtagctgatactgtataattttccgataacacggatgctattctttctcccagccagccataacctataattcctattttcttcatacttcaacagaggttttcattttttgatcatacaaaaatatcaataagttatgattttctggtaaagcaactttttaaatgatcattgaccattccggtggcctgcatatgggcataaactacagtagatcctacaaatttaaatcctctctttttaagatctttcgaaatatggtcagaaatttctgttgtagcaggaacatcagacaatttttcaggtaagttatcaattggttttccgtcagtaaagccccagatgtattgggaaaagcttccaaattctttctgaacatccataaatctctgggcattggtaactgcggccagaattttaagcctgtttcttataattccgggattatccattaattcttcaatttttttgtcagaatatgccgccacttttctataatcaaaatggtcaaaagcttttctgaaattttcccttttggataaaatagtataccagcttaaaccggcctggaagctttcaagaactaaaaattcaaatatggtttcatcatcatagaccggtcttccccactcttcatcatgatatttcctgtaaagatcatctttttcacaccagccacaacgtattttttccataattatcaaatttatatgttaaagttactattgattttgaaaagtataacaaaagattatgaaaaatttaacagagaagctgtgttttaggaatggttattgttcaattataattataacaccaaaatttatatcattatgaacaattcagagtataacaaagcggaaaatgcagtaaataatgtagaaaactctttacagaatgtagcggacaaaaccaaatggaaaatcaatgaattggcagacaaggctaaagactatatcaatgagaaaaggaataatgatgaggaggccagccaggaagactggctagacagggtaaaagctaatgtatccgatgcctgggaagatattaagaataaggcagatgaagcatgggaaaaaaccaaagatgcggcagaagatgtaaaggcagaatggaataagaaaaccaattagtatttcagtcatataaatattttcaataaaatggagtcttaaattgataaggctccattttttattatgccataagcacaattattgttacatttgtattataataaacattaaaaaattatgtcatacggtttacttaaaggcaaaaagggaattatttttggagcccttaatgaacaatctatcgcatggaaagttgctgaaagatgccatgaggaaggtgctgaatttatcttatctaatgcacctatcgcattgagaatgggagaacttaatggtttagcagaaaaaacaggttctgaagtaataggtgctgatgctacttctgtagaagatcttgaaaaactttttgatgccgctgttgcaaaatttggaaaaatcgactttatccttcactctatcgggatgtctatcaacgttagaaaaggaaaacactatacagaaatgaactacgactggttggaaaaaggctgggatatttccgctgtttctttccataaagtaatgcgtgtggcttgggaaaaagactgtatgaatgaatggggaagtattctggcccttacttatattgccgctcagagaacattcccggattacaatgatatgtctgataacaaagcgtatcttgaaagtattgcaagaactttcggaaactactggggagaaagaaaagtacgtgtaaacacagtttcacagtctcctacaatgactactgccggaagcggtgtgaaagggttcggaggattccttggatacgcagaagatatgtctccgctaggaaatgctaccgctcttgaatgtgcagactactgtgtaacattattctctgatcttactaaaaaagtaaccatgcagaacctgttccatgacggaggtttcagcagctcaggagttactcagaaagtaatcagtaaatatgatactgaaaaataataactatctaaggtcatcaacaaaaatcgcattatacttagtatttaatgcgatttttttattaatcagaatcaaggagctgttttatttcataaaacagctcctttgataaaaacaaactatctggtttttacagtaatcttttatttttttaatactttaattttctcagaagtattttgaagagttacaaaataaacacctggcgtaaactctgataaagataaagaatcactgatatttgcttttaaaacgattcttcccatactatcataaatagtcacaatattattactgtttctattttttattatgagattttcgcttttaaaatcataaaacaatgttattttcttgtatgcattctcatttgttcccagatttgtagttgcttcataggccccaagatcaacggcagtgccaaaaatcctgttatttcccaataaatcttgtgtctgggtaacaaaactgttattgcctgcattgattgctgcagaggaaatatccaattgataattataagatgtacagtcaaacggtgcggcacttaaaatatttgagtttgtaaatccaggattaacatttaaaacattggttcctcctgtataaccgttctctacaatagaatgtgatacaatattaccagcatcaacctgatcattattggatgaatttgtatttccgtaaacaatagaattatacagattaaatttaccattagcactataaacagctgtttcaaatgtattggtaaggaatacttttttattatgaacaacagtcacattctctaagatctgaggaattccattactgctgtacagagccagtgcacattcatgataggaatttcctgcaaggattgtattgctgattttcgctgaattattagcatcaatataaaaaagacttgattgattagaggtattatttgtaacgacacatctgtccatcacaaaattagctcccaaaaatctcaatacagcattccctccagctacagaacccttgaatttacaattacttatggtaaggttattattgttggagtcatcagaaaaaacagctccgtatacagatatattactaataaaatcacaattgataacatttacagtgtaattcccctggtaagcctgaaaaatagctccggcggcagacccctgattatcatagaaatagcaatttttaatattaataataccagtattgttgttcaaagaaattcctcctgctccacctgctctcccagaaataaatctaaaaccatctaccgtcaagcctgatgtagtattgataattttaaggatcgtattggtattatccgagctatctccaatagcaccgatatctcctgaaagtgttgtaggattctggctgatatttctttgccctattgaagtttctgttccactaaatcccccatataagctgactccatttttcatgttgaatgagatggttctatcggtggtagaagttgctttgtacactcccgctgctacccagatttcatctccatatatggcattactcatcgctgtctgtaaatctgtataagcattggcccacgaaagaccattgtttgaccctgtggcagatgaattaacatatagtgttgcggcattcatacttgaaaatgccaataaagaaaacaatagatattttttcatggttaaaaatttcgccaaaaatactaaaaaagtaaatacattaattcgaaataatattatgataaatactgaagaaaaatttttcagtatttcctcatgataaaacccggcggcctctttgaggccgccgggtctgtcaaaaataatattaatatgatactataaaattacggtctgtatagagtgtgcaggagcattcagtttggctgccataccttcaatccacaaattggtttcgatatcattatctgaatcattcataataacggttaccaattgtccgttttcattcataaaagcggaagaagtcaatgctgccctgttcgaagaagttccgattctctgggcattgggtttgatatattttgaaacatggcctatataatagtattcgtaggtatagaacacctcgcctgttttggtatctgcgataatcggggcaaagcagaagttacctttatggttaggtccgccggtttcatccaataaaatattccagtcggtccataaagcatttcctttgttaaaatcattcaacatgtttttgctgtacagctcacccaggcttacatcatagattttatccatactgaactgttctttacatccttcagtaaaagccaggaatttatccggaaaagctctgtgcgtttctgccagattatcaaaaagctgtgttttattattccatgtttcataccagtgatagccaataccgctggcatattttgaggtttccggatcacttaatgtggttgttgctctttgatagatcagatctctgttgtgatcccagatcattacttttttatctttatatccgttcttccaaagggttggtccaaggttctttttcaggaactccccttcttcttcggcagtatagatacatgattcccagctttgggtagccattggctcattctgaacagttagcccccagatattaattcctctcttttcgtattctttaatgaatttgatataataatctgcccacgtctggtagtattgattctccaatcttcctcctttgtataaacttttgttggatttcatccaggctggcgggctccatggagaaaaatagaaggtaaaattatttcctattgctttctgagcttctttgatcatcggaattttatacttctcatcatgtgcaatgttgaacgttttcagggaagcatcattgtcttctacataagtataggaatcactggagaagtcacaggaattcatattggtacgtaccactgtatatcccaatccgttttttccaaaataagcatccagaatttccttttgcttattctttggcattttataaaaagtttctgctgaagcgtctgtaatggcaccgcctattcctatcagtttctgatatttaaaattaggagccacaaaaatacaggcctcagtttctttaggctgcccaaattgttcaaatttaactgctcctttatccgccatcttctcattcgctttcgagttggtaaggattactttagctgtttttcctgcattctttttccaataattctgagcattgacattgatgacaacacctactacaaaacaacttacaattagttttctcatgatttttttattttggacagttgcgtcccctattcattatttattttgatagactcttacatagtctatgtaatacttttgtggaaaaacagcatcatcaatgccttcttttcctccccaaaaaccacctactgcaagatttaaaatgataaagtaaggtctgttaaaaggccatgcatcattatttttctctttattctcataggtgaaaaacttttggtcatcgatataaacatctattttttccggtgtccagtctgctttatagatatgaaacttttcgcttgcatcttttacaaacagtgtatcggttttctgggttccctgaatgtgattatattttttggtatgaacagaagcatgtataaatccctgattgtatcctacatgttccatgatatccagttcgccgtcatccggccatttcttcatattctcgctcatcatccatatggcgggccatgttccgcggcctttgggcagctttgcccttacttctactgttccatactggaaggcaaattttcctttggttaaaagtcttgcagaagtatatttattgttttcccagttttcttttctggcttcaataatcaggtttcccttttccattctggcgttttcaagcctgtttttggtataaaactgagcttcctcattcccaaaacctccacctcctacatcatagttccatttcgaggaatcaggaaggcctttactgttaaactcatcactccaaataagtgttctgtgagaatccggcttgtgtgaagcacagttcagaacagaaatgaaggtggttgctgcggcacatattttaatgatatttttagccttaagattcatatgtatgaggttttaagttttggctaaagccgttctttttatattttcataagtgggctaaagcccactcctattgaattgaattcaatttattttgtccagttaattcttttgctctgtacatgttgagagtcagttccaatcataatatcaaattctccgccttcccagtcaaaattcagctcatcatcaaagaatttcagatcttcgggagtaagtttaaaatcgatctttttgctttctccttttttgatgaatactttctggaatccttttaattcttttacaggtcttactacttttccaaaaagatccctaacataaagttgcacgacctcttctccatcatattttcctgtattggaaaccgtaacactgatgttcaatgtctggtttcctgtaaggtttgcagaatttaaaaccatatcagagtatttgaaatccgtgtaactcaaaccatatccgaacggatatttcggatcattatcaagatctatgtaggctgaaacataatttctgtctgtattattttttgcaggtcttcccgtattataatgattgtaatacacaggaatctgaccttctgttcttgggaaagtcatcggaagctttcctcctggattcaccgttccaaacaggacatctgcaatagagtttccggcttcggttcccagccaccatgtgtacataattgctggaatattgtctgatgcccagttgaaaataagaggtcttccggcattgatcatcagaatgattggttttccggttttggcaatttcttgcaacaaatcttcctgaacgcccgtaaatccgatattgcttctgctttttgcttctccactcatcgcatgtccttctcccaatgtcataatcactacgtcagcttttctggctgtttctattgcttctgcaaactgtgttttatcctgatcatccacattacagcctttggcatataataaagtggagtttttatccagctgatttttaattccgtcaaattgagaaacaattctttgattgtcatctttgaaagcaactgaccagaagccgtgattcgctactgtttctttcccgaaagggccaatcagagcaattgtctttgtactttttgaaagcggaagaatatttccctggtttttaagaagaacaatactttttgaaccaaattctctcccgaattttctgttttcctgattatcggtttgttctttttgtcttttttcattgctgaatctgtaaggatcatcgaaaagtcccatttcgaatttcttggttaagattcttcctgccgcatcatctactaattttgcatctacttttccttctttaaccagtttgggaagttctgtcatatacacacggctttccatatccatatcacttccgccctttacagctctttctgctgcctgagctgcatcttttgcataaccatggggaatcatttccccaatacttccccagtctgaaacgacaaaacctttataattccattttccttttaaaagatttctctgaatatattggttggccgttgccggaattccgttaatatcattgaaggaattcataaaagtagctactcctgcctctgcagctgctttgaatggaggaagataagtttcgttcagctgtctgagactcatatccacagaattgtaatctcttccgcctacagcggctccgtacgctgcaaagtgtttggcacaggccatcacagcatccagagttcctaaacctttaccctggaatcctttaattcttgccagtccgatttttgttccaagataggtgtcttctccggaaccttccataacccttccccatctcggatctctggcaatatccaccattggagcaaatgtccagtgaataccataagcggcggcttctgtagcagctattctttcagacttttcaatcattcccagatcccagcttgctgcctgccctatattcaccggaaaggttgtccggtatccatggataacgtcctgtccgaacagtaaaggaattttaagccttgactgcatcgcgagtttttgaaaggccctggtttcttctgatccagcaacattcagcatagagcctacttttccttttttaatttcgtctaaaacaacagccgaattggaatgctgaggtcctgtagcatattcgaacccgctgtattgaaccatttgtcctactttttcctccagggtcattttagacaatagctctgctactttctgatcaattgtcttttgtccgtaagcattcagtccaaatgcggaaaataccagtaagaaataaactcttttcatagtatccaattaaaaaatataggttgctgtagaacgtccggaaattgttactgcagcggttttgccggcaaatttaatattaaaattctcatctgcctgattatcgttctgtacaattaaaactattttcccaaattgagtcataaaagcagctattgaaagtgtgttggtttgtgtggaagcgatgcgctgagatcctgccggaacaaattttgaagcatgggcaataatataataggaaacatttctggtgaagttttcactatcagaaacggttatggcgcctttacattctgtacatccgccatctgtatgaggggcaaatttcggatcgttggcaagattccattctaaagcaattttgctccagttcctcatggaacctatgattacattttttgtatgccagttcagatcttcggtaaaagttccttttgaacctgtccactgctccgtaaagtatagatttttgtctggaaaagcattgtgcaccgtacttaatgcggagatatctccttcgtacaaatgaaaagctgacccgtctatatatttgtttgcctcagcatcttttaaaatatcaatagcatattccggtttgttgcagttgtggtcgtaaacaacaattttagttttaattccattcgttttaaaagccggccctaaatgatttttgataaaatctccctgctgctcagacggcatatacatacttggattatttccaggatgtaaaggctcattctgaggtgttaccgtatcaatggtgataccttcttttttcaagccttgtatgtattttacaaaatatcgggcataggtttcatagaattcaggtttcaggcttcctccttttgatttaccattgtctttcatccaaaccggaggagaccatggtgccgcgatgattttaacagaaggattgatcgctataatctcttttagcatagcaatcagatttttgtcctttgccaggctgaattttgaaagcgaaggatcgctctgcccttcaggaaggtcgtcatatgaaaatacttctccatcaagatcggatgcgcctatgctcaatcttaaataactaatggagattgaatttttactatttccaaaaagctcatgaagcagtgcttttcttctggaaggcgacaaccggttgattacctcaacgcttcctcccgttaatgtatatccaaagccatcaacatattgaaacttttgagtatcatcaatttcaatattctgaaagctgttggaactgtttacaaatttaacagaagcctgctgctgtaattttacactttcatcaccttttgtaagccagtactgtacttcatttactttgccggaagatactgagccacacgataaagaaaaaagggccacaccactaagcagtgcggcacctctaaagaaactatataagttgtgaaacttcatggattaataaccaggattttgttttaaaactgtattcggcaattcattgaaaggaattggaagaatttcatttttattggctttaaatcctttgaaggcaagcttagaaggagcatcaccccatctgacaagatcaaaccatcggtgtccttctccggcaagttctctccttctttcatctttaatagcctgtaaagaaacagggactgatggtaaaccaactctagctcttaccgcatccaacaaagcctgagctcttgctccggctgcacctaatgcttcagcttccatcagataagtatctgctaatcttattgcaatataattctgacggaaattaagctctgctggtcctggaagtgagcttttcaaagcatttgtaggcagatatttatttaagaaatatcctgtatcagcaaaggccgggctgtaggtaattttaccatctgctaccagtttttttgcattgaaaacggttacatccaatcttggatctccctgcataaaagtaacaaagttttctgtcacagtattaaatgcccaaccggaatagatatccggggcatcattattcgggatgttttttagtgaataagaacgcggtcctaccattacattaatagagtttccttcatctttaccctgtccccagaatccccaatcggaatttcctttattcgtatgcattacttccaggatagattctgttgaaaacttataaggatctgataattcggggcctactttaaataagtctgcataattggctaccagtttgtatccatattggctggttcctcccggagtaccattcacctgagcaaactgtgcagccgcctctgtcattttcttgtcataaagataaatcttacctaatatggctctggcagttccctgtgtaactcttcctttatcattaccacttgcagtcatcatcagatctggaatagctgcatttacatcactttctatctgtgcatacacctcacttggtttagcctgcggaatattccagtaatcatcatcgaattttacagatttcagaatcaaaggaatgttcccaaacattcttaacagctcgaaataatatagggagcgaagaacttttgcttccgcaatatatcttttcttaagatcgtcactcatattagctccgggaactctttctattaaaaggttagcacgtgctattccctgataataatctctccagtaactggcgggcatcgtgtttgggttaatcatataattgtttaacccctggatacctgctccatcattagagtttcctcctccggaatagaaatcatcagatcctgcattaaaaaatgttacggtattttcaaaccctcctgaatattttcttaaaacatcatagaccgaaaccagtgcactgaaagactgctgttcattctggaaatataaatcagtattaaaagatcctgaattctgcacgtcatccagataagaatcgctacaagcgatattggttaaaccaagacctgccaaaaatgctactgcaagtcctttatatataaaattcttatttttcattttgttagtcattaaaattgaatattagcacctatcaggaatgttctagcctgtggatagtaagccctgtctactccaataatatcttgttcggaattatttcttcctgcaatttccggatcatatcctgtatattttgtgaaggtaagcaggttttctcctgtgatatacagccttactttgctcattccaaaacgttgtgtaacatcctgagggatggtataacctaattgaacaattttcaagcgcacataatctcctttctgaagataataattggacatccatgaatagttgtggttcgggtcattacgcgtaactcttgggttatcgttggtagatccttcacctgtccatctatctaagattcttgtctgatagttggcatcaagcatatccaatcttctcagaccctggaaaatcttgttgccggcctgtccttgtgcgaacatcattaaatcaaaattcttataattaagattcacagtaagtccgaaagtatatttcggaatagaacttcccaggtttaccttatcttcatcatcaattttaccatctccgttgttatcctgccagataaaatctcccggttttgcatcaggtaataattttactccatttgcatttacataattatcgatttgcgcctgattttggaaaacaccactataagtttgtccgtagaatgatccgtatggctgccctactgctactctggaaacagctcccatagtctgaaaagaagcaaggttaaaatatttaatgtcatcttccaatctgagaacttcattttttatcgtagcgaagttcccattaactgaaatcccgaaatcttcccaattcttcttatatcctaattcaagctccagaccactattctgcatgtctcctacgtttgaccagggtaaattcggaactcctacatatccagggatattaatttgcctaagaatatctgtcgttttctttttataccaatctgccgtaagtataaaattgttgaatagtttcaaatcagcagcaatattcagctggctggtctgttcccatttcagatttggattttcaagtgtacttggcgcataaccaatgataatattgtttccagagttggtatagttacttccggaaaccatgaaacttgcaaatttgaagttgtccatttcatcatttcctaaaacaccataacctcctcttagttttaaattattaattactttgttctccggccagaagttctctttatgaacattccatccaagggacatagacgggaaagttccccagtgctgattcgtagcaaattttgatgaaccatctctacggatcgttccggtgaataaatatttatctgcataatcataaataattctaccaaaataagatgctttacgggtttgaattccatcccatcctgttgcggtaatattatcctgcggaatattaaagttgaaggaagcatcctgccagttatcgataggtagattactgtacgtcaaactagccccgccggcaatgttgtaccggtaaactccctgtcctaccatgatattgatgttgtgatcaccaaacttgttctgataggtcaaagtgttttccatactccattcaaatttattttcatccaccttattcagactgttgaaactggtattgttatagtttggacttaaataatatttcggagtaaaagaacggcttccccaataagatttcttaccattcagactggatttaaatgtgaaatgatcaagaaacttaagctcagcaaaaacatttcctacaaaatcatcagaccagctataatttccttgttgtatatgacggaaagcctgtggattggtcatttcctgatttacatatctggaaattccgtatggtctcccttctgaatcacggatgatataaggattggtataaccgcttggatcaaccattgaccaatctgtcactacaaccggagttgtaggatctaggttaactgctgaagccagaggccctccaaattcttcatttgcacttactccttgggacttcacatgggtatacgcaaaggtttgccctatggtcaggtaatctgtaactttatgagttgagttaaatcttgcattgattcttttgtaataagaaatatcactcattacaataccagtctgatcaaaatatccgaaagaggtatagtatgttgatttttcattccctcctgtaatgcttacctcgtgagacgatttttcacctgtcccgaaaatagcatcctgccagttggtaccttttccaaatgattccggattcgcaaaccttggtgcctgcccatcattaacaaaaccttcattaataattttggcgtattgtgtagcatctaaaagatccagttttttggatgcatttgagaaaccataaaacccgttataagaaaggctgagttttccttttttaccttttttggtagtcaccagaattactccttttgcggctgaaaccccatagattgcagatgaggctccgtctttgaggacttctatactttctatatccgactgattaagccatccgatattgtctacaacaataccatctactacccataaaggactgttacttcctgctccaaaactggtaattccccttacacgtacagtagcagcggcaccaggctgtcctgaattggtcacaacagaaacaccggcagctctaccctgtaaaacctgttccggtttaccagatggaatgttttcaatgtcgctggctttgatacttgcaatagctcccgttacattactctttttctgagtaccataaccgatgactaccacttcgtctattttgttttctttagcaattgtgtcctttaccttggtggtctgggcactgaagttggccgtaaaatagaggacggcaaccactcctacgcttcttgatattcttacattcatatacagttattgtttaattctcaaattgagacaataaaaatatattttttttcaattaattaacattctattcataaaaattttaatttttcttttatttttcagggttagaagcactatcttcgcattaatatttcataaaatttcataaaaaaacaataaagacaactcccaaaatgaccttcaagctttccaaaatttcccttccgttaaaacttacctttctcattttttcaatggttctgaactgtatgggacttatcattctgcagttatccgaagagaaaattacctatggtgaactgggacttttggagtctttcaaagatttacccattgcttttatctccctatttgctgtacgctttattaacaaaacaggaacaaaaaaagcattgatttcagcgttggtaattgtcggattctgctgctgccttcttccttttgcagaagttttctggttttttaaattatggttcgccatcataggagcttgttttgcaataggaaagatctgtgtttttgggataatcaggaataatatttcggatgaaaaatcactggcaaagaccatgaacagtgtagaggcttctttcatgatcggaatctttgtcgttaatacctgctttggatgggtggtttccagccaatattctgaatactggaagttttgttttttactgatcgcttttttatgtgcactagcgatcttcatgttatcaaagattaccatctctgaagccaaacctattgaaaacaaaaacattttttcagaattgtcaggatttacaactcctgctgtaatactattccttggggtaatattttttattgtttttatagagcagggatttaattcatggcttccttccttttataaaaatcatctgaaagtcaattcattttttgcacttcaggctacttcttttctggccgtattttcttatgcaggcagaacagtaacggcaaatattatcagaaggttttcgctaccgaactactatatctcatgtatggccttcattattggtttattgctaattattgtaggaatacagtattttgagtcggcagattcaaggataattctctttttattcccagtgattggtttgtttttatcaccactctaccctgtcatcaattcaaaaatgattgcacagattgataaagaacaagtaaatcttttcacctcccttattgttattttttcttctttgggcagctctgtaagctctattattatggctgttttgtttgaaaaacaatggctaaatttctatccgctatatatcttatctttcgtaattcttctttttgtgattagtttgatattttttaatgtttcaaaaagaaaatagttttatttttactgccatgaaaatcaaagacacaaaaagtaaagaaacacttcaggaactgatcgatacaaaagattttgttgctcacatatctgttgactgtactattttcggctttcataataatattttgaaagttcttcttttaaagtatcacgatctggatctgtggtcgcttccaggtggttttgttttcaatgatgaagatttaagagaagctgcagcaagagttttgtttgaaagaacacatcttgaagatatttttctgaaacagtttcacacgtttggaagaatagaccgtacggagaataatgtccatcagattctcctgagaaacaaaggtattcaggtgccgccggatcactggatttttcaacggtttatcacggtggggtattgcagccttattgatttttctctggccaatacttttccggatgcttttaatgaaagttgtgaatggttcgaggtaaacaatctgccaaagatggcttttgatcacgacaggattattgaaacaggattagaatacctgagaatgaacatcaatacggaagtggcagccagcaatctgcttcctgaaaaatttacgatgaaagatcttcagtctctttatgaaacgattttaggacaaaaattcagaaggaataatttccagcgtaaaattttaagcttaaatattcttgacagacttgaaaaactttacgacggttcagccaataaagcaccctatctctataaatttaaaagcaaggttcacaactccaccagccagtatcctatatccaatgatgaggagtcataaaaatgtggaattttcattataaacaaagaaaaagagcattatctacctgaaaaccaatctcaagataagttttcaaaaaaattttcacgacaacacgaaaaatgttacttttaaccaaatcaaaaaatcatgtcatattatcctcttacaagcatccctgattattatggaattgatgctttacttactgaagaacataaactaatccgccaatctgtgagagactgggttgaaagttttgtaatgccgcagatagatcaggccgctcaaaatcatacagatctaccgaatcttatgagagaattggggaaaatcggtgcattgggaccttatatcccggttgagtatggcggttcaggattagaccagatttcttatggtctgattatgcaggagctggaaagaggagattctgcagtacgttctgcggcttcggtacagagctcactggtaatgttccctatcaatgaattcggttctgaggaacagaaaaagaaatatttacctaagcttgcagccggagaaatgatcggatcttttgggttgacagagcctaaccacggttctgacccgggttctatggaaactaattttaaagatatgggagatcattatcttttgaatggggctaaaatgtggatcaccaactctcctctgtgcgatatcgctgtagtatgggcaaaaaatgaggaaggaaaagtacagggattaattgtagaaagaggaatggaaggatttaccactcctgaaactcataataaatggagcttaagagcttcaaaaacaggcgaactggtgttcaataatgtaaaagttccgaaagaaaatctacttccgggagtaaccggactgaaaggcccgctttcttgtctgaattctgcaagatacggaatttcatggggtgtaattggtgctgcaattgactgttattgcactgctgttcagtattccaaagaaagaaaacagtttggaaaaccaatcggttcttatcagcttcagcagaaaaagctggctgaattcttaacagaaattaccaaagctcagttgctatgtcttcagttaggtaatcttaaaaatgaccataaagcaactcctgcccagatttcaatggctaaacgcaacaacgtgaaaatggcgatcgatattgcgagagaatcgagacaaattcttggtggtatgggaatcatgggtgaattcccgatgatgagacacgctgctaaccttgagtctgtaattacttacgaaggaacgcatgatgttcatttattgatcaccggattagatatcacaggaatcaacgctttttaagaaaagacaaaatatagataaaaggagtctggccaatggtcagactcctttgttttactcacattgcagagaattgatattcattgaataattattaatgtcgtaatgttttcctgtttttgttaaacttattaccttaataccacataaaaaaaaccaatatgaaaaaaatcacaacttttttattaagtcttacggcgtcattttactttgcacagcaggcaggtgacgttgtaagtgccgaacagaaactggatttaacaccacaaggtgttattaattttatcgccaataatctcggcgaacagaacgctccggaattctccagttatctcagcagttttaatgttggtttaaaagggtacaaaattacctattacaccaaaaatgaaaataatattcttgtaaaagccacgggattacttatgtatcctaatgtgccatttaagctttcaacagtagtttccgaccacggaaccacagacagcaggtataatgttccgtctaatttcaaaggggcattaacggcaggatttgtagttgaactgtcttatgtccttaacggttatatcttaatggctcctgattacgtagggatgggaaccggtgatggagttcatccatatgtggattacgccacagaagccggagctaccatcgattttatcacggctgccaataaagtactggcacagctgaacattaaacgttatgatgaatactttttagccggctattctcagggagctcatgctgcaatgtctacattaaagagattaagtatttcaaaccctgataatatcaaattcaagtatgcatatatgggtgacgggccatatgatttttccggagtaactctgaataaaggtattcttgaaaaagacttttatccgtttacttcttttgtagccaatgttgttaatagctgcaacaatacaggctacaaaacatacaataatgacatttcagaagttatttctgctgaatacctggataaatacaattatcatgttgttcaggataacggcggcctgttatgggggcctgtaatctggagaaaactttttaccggcagctttgtcaatgatgttaccaataatcctaataataagctcagacaatgcctgaagcctaaagatgtctatgactggtataataaaaccccgatgacattaggccattcaactgttgatttagctattccgcctgaaaatacgtccaagacaattgatgttcaacgaggatattatccgtggtgggatctgaataaatataaactggactcgttttattggggaccacttgggcatgtaggaggaattcttccattcactctggcttccaacgccaaattcaatatcttgagaagtggcggcttacttaatgaatgggcaattgcaggatcaattttcggtaagcagaacgccgagaaaacctctgaaaagcctgcactgttttcttctcagataaaaccggatctcggaacgatgcagcttcttgaaattacagatttcaatcaggaaaaaacacagaaaaagactgctgataaccgtaatctggcaactttaaaagatggcgtttatttattgaaagtactggataacaatgaaagtaaaataattccctacatcaaaaatacaccaaaacaagttgctgaaaacgaaatcatacaatctgctactccatccgttttgcagttaaaagttgatcaggatgaacttacttctgtgaatatttttgacgaaaataaatcccttatcaaaagtatttctcagaaacaataccgtgaagccggaggaattgatgtacaggatctggaaaataaaaattatacctttgaggtggtaactccttattacaatcttcaattcagtaaagcaatcggaggtacatcatcttccgaaaataatgcagatatctttgcccagaaacagcagattattgcaaaagccggcaatggtatcaaaaacatcagcatttacagcatttccggttcactgattcttcagcaggaaattaaccaaccattgtttgaatccagaagcctggagtccggggtatacttggtacaaatcaccttgtctaatggaaaagtcatcaataaaaaagtaaaactttaaatcaatcactcctcaatatcttatttcaagttaatttttggcacttcagcaatgaagtgctttttgttgcatatccttaaaacttaaacccgatgctaaaatatatcctggaaaaatccagctgattgtttctggaaaggttaagactgatgggtcctattaaagattcataccccaggtttacaccataaccaaacatatcaaaactgttattaaaaggagaaaattcctcgctcaccttcccatagctgaacgaaggagtaagataaagtcttttcataatcctgtactgaaatgccacagctgcctttgccacggaagtcataggaagttctttctgacgaagcccgttgaattcagggcttagaagatcataattgtactcactgcctcctaaattgtatttctgattcaggaagagataaggtacctggtcttctctctgtgcaccaaagcttgttcccagaaaaagattcacttttgcagcaagcctccttgtgataggataagcgaagttttcatttaatgtaaaagaaaccagattttttggctgataataataagagtctttaggattaagtataggatataacagcggctgaacggttttcagatcatacagctcatattgatctccgtaataaaatcttgtacttacctgcagattattcccttttgtaaagaaatatcttttgttgagattattctgttcaaacttcagaaacgtattaaaattactgtgattatacagttttttactgtaattgtccacttttgcctgatctactttatccagtaaactgtacattctttctgtactgaactctgttccgagtgaaaaataagcattagggcttacattatagttcaaagcaatctttccggtgatattgcggtacatatggttaggaaaactatcaccaccatcagcccctacatcatataacctgaaattcaagtcgttacttttaagatgaatcatcttagcttccagatccagccacagccgttctccactgtctaaaaactgctgataagcaattttagctttaaaacgttcagaaatatctaccgttgccagaaatcttgatctgttcaggagaatattcctgtaggtataattgacaataattcccaccgactgctcagtatcataatgcaaagccagtttgaaagccccttttttggctcttttcacaaaaacattcattataaggccatcattttcattcgtataagtataatacaccttcacatactggcgcattccgaatacgcgatctattgcttcatttactgtttttacatcataatatttcccttctgtcagtcccatctgttttttaagcacttcaacttctgcggcatccttaattggagttccgtcttcttcattgaaggtaaattttgtagtaggcagttttacttcctcaatcatctcatgctcatatttgatcccggcttttcgctgggcttcagcaagggcaacaaactcaggaagatgctttctcgcctcggtttctcctattttgataattctcctgaatctggcaaaatccttcgttgtaatctctcccaagggatctacaaaatccaccaggatatcggacaattctttctgatgcttgaaatcttctacggaacggatagcatgggtctgataaatcatcttcatagggttttcaatttctttcttggtgaaaagcctgaatcctgtatagccaccgatcacaaaatccgctcccatctcccgaacctcattggcggggtaattacggtctaatcctccatccaccaaaagttttccatcaatataaacaggagcaaaagctgccggaattgccaatgtagcacggatagccaacggtaaagatccctccttctgcattaccaggccaccattttcaatatctgaggaagtaagctgaacaggaattctcagcttgctgaaatcattgatatgttttgcattaaatgtaagcgtattcaaaacctctcccatatactgcccttcaatataagagcttggaagagtcggaaatcctttcactacagggaactcaagaatatatttgtcatattcatctttctcactgatattgactttgctgtaaggaattttattactgagaatcctgttccaatccattttatagatggtatgcttcagctggtcagcattatatcccattgcatacaaacctcccagaattcctcccatactggttcctgtaatataatctacctttattcccaatgagtctatcattttaagaataccgatatgtgcgaacccttttgcaccgccgccactgagtgccagaccaaattttgtgtctttggttatattctgaagggcaatattcagggagtcgttcttttgctgtgatttgataataagagagaaagctatggtaaaaaatatcaggatctttttcattgttagttcttggtgtatccgattttaacttaaaaaagttttataaagagtaaagatacacaaaaaagttaccggtaaaattgaacggttatgtgaagtagataaatcaatttcggcctgtaaattaaaataaataaaccgttgattttcagactacatatcttttcaaatcaatattaaatatttttaatacgtttttatagtctcaacaaagttaatatcaggattcagaatttcgaggataaggcttttgacagctctcatggcatcatcaatatttcctttgtcaaactgcagggaaaccattccttttctggcatctgcaaagctccagatccctgtttcgatcgggtatccccaaaattcgggaagatgctgtacaacgtaatggtaaatacaaagctgaagcgcctgttttctgtcactgttatggaaatattcagccacattatcttcatcaatttttacattgagatttttaattttggctgttttataatcaataattcttagcgttccattgagcttatcaatacggtcaatgaacccgaagaaagatattttatcatttccttcaagaggaaaatctatattttcaaatcttctttcgatatcaacaatttccagtttgttgccttgctttatcagttcaagatcgtgattcagaacattctcaattacttttttagcgatggctttgtggatatagttcattcctttttcatagaattcaggctgatgcttcagcttttcaatggcaacatttatatattcatctattgctttaactgaattctttaaatcactttcttttaaaatcttacccttcaacacctcatacacttcttgaagtgaataatgaactagatttccgtaatttttcacagaaagctcttcttcaatttcatccgtttccgaggtatttaaaatctttgaaagatagaaatcaatcggattatagaggtaactggtaaggtgtgatgcagatactttttgcttccatttttcaagtcgttcctgtacaatctgtgtcttggagatttctataggttgtgttgcaataggctctgaagaattttcaatgatcaggtgttctatctcatgtgaactttccatttcaatctgagtaataaaacggctcttctctcctgtattcactccggagcttaaagcattgtacaacaaatggacattctttgcatcctgaatcaacctgtaaaagtgataggcataaatgctgtcattttccaggaaggtatgaagatcaaagaaccttcggatatcaaaaggaatataggtattctgagagtttccaagcggaagttttccctcgttcacagaaagcagaataacgttttcaaaattcagcagacgtgtttccagcaatcccatgatctgtaatcctctcaatggctctccctgaaaatcgatactttcagagttgatatgctgattgatcagaatttccagcgtttccatcttgatctcaatattgtaaggagtcagctggtttttaatgattctgaatgcattttcaaagtgagaaacattctcatactgaatatcatctatttcaagccattttacctgctggcagaacgctataagcatatccagataagcatttgttcccggagctttctgcaaaagcccgaaataagaaagtccgctcagcagttcatgcaaaagtttatgagagatataaacgatgtttctctcttctactttagctttaaagtcattaataatctgttcatcttcaacagattttggcaactcttcaagaatcgggaaaacatccctatagtaataggaagatttatttttttccagctgtttctgcagatagaaaagacgttttatggcattggagaaagacaggtttttcaatgggaatcccattgtaatattcaaattgtcaactccatgcatcacatcaaggcttgcaggtagaaggttttcatccagcagtacaacagctgtattggaataggttttattattgatctctttaaaaatttcgggcagtacttttgtctgggttacattccccgaaacctcatacaccttaatttttttaggttggttaaaatcatcttcaatccactggaaagccctgttgtcatcaaattctttccatgttttatggtttctgaggaacttaccggcttcctgtctttcgtcattgaaataataccggtcagcctgaaagaagcattgggctttattccactgtaaaagacttctgacgagcttttcttctaccggagtgaaggcattaaacccacagaatacgaactcctctcttgtatttttagcaaaatcagcaaccttagctttggcagcttcatgaatcattcctgaggtggcccagtttttttcctgtaatctcttttttaaagcaggaagaaaaacattcatattctgccagaaattaaggaatttctttcttgggacctcatcatcctctccaagatcctgagcccattctttgatcctttcttcatcaaacatatactgcagaaccgcctgatcgttgtctgaaaatttaagaatatcatcccaatccttctgtaacgttggaaaccacttcagaaagtctgaaaaatcatccctgggaataagattcaaacttctatacacatcaaatgaaaaaagccacagcggaatcccctgaataagctgttgtcccgcaatgttattcacgagctcttcaatggtaaaaaagttgggaagaaaccctgaataatgattctcttccagaatctgccggataaatacaatgggacgttttccgggcagaatgatattaaacgcagaaagatccgggttttgtgctagcagttcgtggatgatcttattaaggaatttcaaagggcttgatagctttttaagttgtctagttgttcagaaattaaatcgttatattctgcctgtttttctttgtcaatgccgtgacgggtttctttgtcgtaagccatctggaaattcttataatccatggagattccgtcataaattgctttgaaatacttgttgtaatctcctgagtttttgattttttcagcaactgactttctgaatttcctcacaaataactctgcgatgtcaaaatgtttctgttcgtgcagcagaatataatcattcatttttttgacatctttccatgatttttcttcatggaatatggttgtaatggaaatcgtaacaggtgcctttggatctgaagattttacagcggaaaactcccagccacaatgggtatatgctgctacatcgggattctttttattactgaccggacttttaaaattatcccaggtcagctttttatcttcctgccaggtaatcttctgtccgaatactgcctgtgctgccagcagacacaatacgatactcaatttcattattctactacaattgttttggtaatccagctatttcctccgttccagaatttaaaagtataagtgccttttttctgcggactaaagttgatctggctggctcccacgtaatttccctgtgtacaaggtccgttcgtaatatatttataagaagtcaccgttctttccagattggtattgtaaacataatcatatccgtaaaagccttcacagtgtgacggatacgtggaataagtctttatgctctgtattgcaaaaacatccatggtatcattgacaatttttacgctgtcgattttgatcttatcaattgattcaatcgtctggtaatcatcatcattacacgaaaccagaagcccgccaaacacgaatactgaaaatccaatatttaaaagttttttcataacctttagttttctgattattaacaaatattagcaaaaattattccttatttacttaaaaatcaggaattaaaattaccttttgatacataaactacctttttagtatcaaaaaattcttcatcaaaatagtgtttaaggttgaaaatttcacatttaattccagccagttcttctgcaagatcaccgccttttaaatataaaatcccattatgtttagggttaaactgttctttttcaaatttccctttcagccatcttaaaaattcaggcatctgggttaccgccctgctgaccacaaagtggaatttctctttcagtttttctgctcttccgtggatagccgttacattggttaaacctactccatctgctacagcctgtaccacactgattttcttcccgatagaatcaatcaaagtaaattctacttcaggaaacaggatggccagcggaattcctggaaaacctcctccggttccgatatccagaactttagttccgggagcgaatgccatcacttttgcaattccgagagagtgaagaatatgtttttcatacagggattccatatcttttctggaaattacattgatcttttcattccattcattatacagactttccagttgtgaaaattgttctttctgtttttcagtaagatccgggaaatattttaatagtaacgatgcagacatgtgaattattataaaccgcaaaaataagttttatttctcttgtattcaaatctactttccggataagcattgaactcagctttaactgagattattatttcgcaattcccggaattaccggcacaccaggattccctgattggctgatcgtttgtacagcaaaaatataattgtctttcgaaagtggtacttttatggaaagtcctgttgtaaagatttttttctgccacaccggactgtcggtttcgcgggccaggacataataccctgccggcgttcctgattttggtttttcccagtgaagcgttgtggagttcgttaattgcttaacatccatttccacattctcaggctttaaagtggattttgcaaggttggccagtaccgcaatgttggcagcaacattcttcttcagatatttaaaatcaataaattcagtcagatcgccatattgcttgttattttccaccctgatatcctgatgctgatgatcatagttttcatagtattcagtaagtcttacagacggaaaaccgttgttgacaaagctggtatgatctcctccccgtaaaaatcgatcatttctgtagatcagctttatttcaagtcctttcacatattcttccgcaatttctttgatataccttgccagctgtctggattcgctgtcattttcaaaacccagatttctgatattcattgcttttttatcgaggtctttgtaaggcagaccttcactgaacacacgaagggtccgggtattgatctctcctgtttctcccgctttgggattcccgatcatatcattattcagaacggcttccagttgtaaaccttctttctttatcttttccgccagctgtttagagcctagcaacgattgttcttccccagagaatgccacaaagataatcgaggccggaaatgaagacctgctcaatattcttgcggattctatgactccacttacgccgctgccgtcatcattggctccgggtgctgctgaagttccgttcattacatcagtcactcttgaatcaagatgtcctccgatcaggaaaattcttttatcgtttggatcagttcctttcagaaaagcaacagcatttcccaggtttaccggcttgtcaattctttttccatccggctgaataccttcctgctgaaggtatacttccatcctgccttcggagtttttagcataatcattgaactttctgatgacccagtttcttgcagcaccaattccgtgcttaggatcatcggttgaactcaaagtatgccttgtttcaaagcttaccagcttattgatataagatttcagcgaatcttcgttgacctgtgagacatactttttcacttcatcatctttggaatgcttctgagagaaaacagtacatgaaatcagcaataaaaaaacggaatacttcatagaataggtcttaaatgttttaaagatacaaaagactgagcatcagaagtaattttattcttattatctcactgtacagattaaaatttaatcgtctgcaaaaaaacaacaggatattccaactggatacatttaaccaaaacctgacaaaaatcttcaattcagccccatttttattgtccctgcaagacgtttttatcatatatttgttaaaattcaaaaaatacatggataaactttcagatagagtaaaaagattaggatactcacagacatttgttatgtctaataaagccagagagatgaaggctaacggaatagatgtaatcagcttaactcttggtgaaccggattttgatgttccggataatatcaaacaggccgctttcgatgccattaatcagaattacagccattattctcctgttccgggatttctggaattgcgtgaggcgattgcttataaattaaaaagagacaacaacctggaatataaacctacccagatctgtgtttcaaatggtgccaagcaggccattatcaatgttctcgcagctatcatcaatgatggtgacgaagttcttcttcctgccccttattgggtaagctatgatgaaatggtaaaaatgatgggaggcacttctgtgattcttccgacatcttacgttaccgattttaaagtgactgcagaacagcttgaagaagctattacagaaaagactaaagcagtacttttcagttctccatgtaatccgtcgggaggttattacacctatgacgaattaaaatctatcgcgaaagttatcgcaaagtatcctcagataacgatcatttctgatgagatctatgagtatatcaactacgaaacaaaaacgacatctatcgctcagtttcctgaagtatacgaacagacagccgtaatcaacggaatgtcgaaagcatttgccatgacaggatggagaatcggatattccgcatgcccggaatggctggcaaaagcttgtgaaaaggtacagggacagatgacaagcggtgctaatacgatggcacagagagcttctatcgttgcattaaaaacagatccttctgaatacaggtatatgattgatgctttcaaaaaaagaagagatcttgtgtatgaattaatcaaagaaattcctggatttaaagtggtacttccaaaagctgctttctatttcttcccggatatttcatactatatcggaaaaacattgaacggaactgaaattaaaaactctgacgactttgcgatgttccttctggaaaatgcgcatgtaggctgtgttggcggattctctttcggaagccctgaatgcatcagattctcttatgccgcttctgaggaggaattaagagaggccatgaaacgaatcaaaaacttattggaacaattcaattaacaaattaataacccaaaataaaacacgacagcaatgaatctgttaaaaaaactgaccatcgccacaagtattgccgcagcgagttttgcgggatatgcttttggccaggatttccagtggaaagaagctacttcgaatggctacaagtacaagtatgtaaccaatgaccctacttccgcaaggtattacaccttaaaaaacggactgacggttattttgagccctaccaataaggatccgagaattcaaacttatattgcaacaaaagcaggaagtaaaaccgatcccgcagaccacaccggtcttgctcattatctggagcatatgctctttaaaggaacgaatcaattcggttctaaggactgggcgaaggaaaaaccgttgctagaccagattgatgcactttacgaaaagtacaatcagaccaaggatgaagctaagagaaaagagatttacaaagaaattgacagagtttcaggagaagccgcgaaatttgccatcgcaaatgaatatgacaaaatgatggctggtatgggagctgatggcaccaacgccttcacttcctttgaacagaccgtatatacagaagatgtacccgccaacgttcttgacaaatttcttgctgtacaggctgaaagattcagagaacctgttctgagactcttccacacagagctggaagcggtatacgaagaaaaaaacagatctcttgatgacgacggagataaagttttcgacaccatgtttgccaatcttttccctaacaacaattatgggaaacaaacgacgatcggaacgattgaacatttgaaaaacccttcactgaaggctatcagagaatattacaacacgtattatgttcctaataatatgggaatcatcatgtccggagatttcaatccggatgaagtgattgcaaagattgacaaggctttctcttatatgaagcctaaaacaattcctgaatataaagtaggacaggaaaaagaaatcagcgccccgattgtaaaagaagtagtaggaccaaatcctgaaaatgtaatgctcggattcagatttccgggagcttccaccaaagatgctagaatgctgaaccttgttggaaacatgcttactaacgggcaggccggattaattgatcttgaccttgtaaaaaaacagaagttacttggcgcttatgccggatcttatgctttaaaagactattccgttttgcttctgcaaggaaagcctactgaaggacaatctctggatgaagtaaaaaatcttcttcttcaggaaattgataaattgagaaaaggtgagttttccgatgatctgatccagtctattgtaaacaatgagaagaaagggatcattcagaaggatgaaaaatattcttcaagagcaagtatcctgatggatgaatttacttctgacattgatcataaaacatcgctggaatatgtagatgaaatctccaggcttacgaaaaaagatattatgaatttcgcttccaaatatcttcagaacaataactatgttgctgtttacaaaagaaaaggagaagacaagagcattgtaaaagttgataaaccaaccatcactccggtttccgttaacagagaagatcagtcacctttccttaagaaaattgatgaaatgcctgaaaaccctattgctccggtatggttgaactatgataaggatattgataaaaacaaattagcaggggtagatgtactttctgtaaaaaatacagataacgccctgttcagaatgtattatcattttgattcaggaaaatggaacaacaaaatccttccgttggcagctgaatatcttcagtatttaggaactaaagataaatcgtccgaagtcatcagtaaggaattctacaaacttgcctctagctttaatgtgagcgcaggaaacgaagagacctatgtatcactggaaggtttaaacgaaaacttcgataaaacagttgctctatttgaagatctgattaaaaactgccaggcagatcaggcagctcttgatgcttataaggttagattgaagaaagccagagccaatgctaaacagaacaaaggagttatcatgtccggattgagaagctatgcacaatatggccctcagaatccattcaataatgtattgagtgatgctgaacttgacgcattaaaggctgaagacctgatcaatgttcttcacgacctgtttaatttcaagcataaagtactgtattacggtccgaaaacaggaaacgaggtggttgcatcgctaaaaccgatccacaaacttcctacaacgctgaaagatcttcctaagtctaaaactttcgttcagattccgacagataaaaacaaggtattgtttgcgcattatgacatggtacaggcagaagttttctgggtgagaaactccgatcagtacaatccgtcaacgacgcctactgtaagcctgttcaacaattatttcggaggcggtatgggttctattgttttccagaccatcagagaatctaaggcactggcctactccacttattcttattttgctcttccaagcaagaaaacagataaggatatgattatggcttatgtaggaacccaggcagacaaattcaatgagtctacaacagccatgaatgagcttttaacaacgcttccaaaatctgaacaattattcgaaacagcaaaaagcggattgaaaaaatcaattgcttcagaaagaattactcaggacggaatcattttctcttatctgaaatcccaaaggcttggaaacaattttgatatgagaaagactgtgtatgaacaggctccaaaactatcttttgcagacatcaatgctttccatgacaaagagatgaaaaacaagaactacacctattgccttgttgcttctcaagataaagtaaatgaagccgatatgcagaaattgggtgaagtaaaaaaacttaatttaactgaaatatttggttattaaaataaacaaaaagccctgatgtcagggcttttttattaaacaacacgtcaaaaacaattatagattttatttatcaatatttgtttgttcgatagatgaatcttttatatatttgcgtaagaaatttaaatataaaaacagaaaaattatgtctttagtaggaaaaaaattcccgaatttaacaattgatgcaatgtctgaaatgggtgacgatcttagaatcaacatccttgatgaagcagtaaacaaccagcaaaaagttcttttattctggtaccctaaagatttcactttcgtatgtcctacagagcttcacgctttccaggaggctttaagtgaattcgaaaaaagaaacactaaagtaatcggtgcatcttgcgatactaacgaagtacacttcgcatggttgaacacaccaaaagataacggaggtatcgaaggagtaacttacccacttttagctgatacacacagacaattggcaaacactttgggaattgttgatcaggatttcgaatatgatgaagatggaaacgaagttttcacaggttctaacgtaacttacagagcaacttaccttatcgatgaaaccggaaaaattttccacgaagcggtaaacgatatgccactaggaagaaacgtaaaagaattcttaagactaatcgacgcttacactcacgttcagaaacacggtgaagtatgtcctgcaaactgggaagaaggaaaagaagcaatgaaagctgacagaacttctactgcagaatacttagctaagaactaatataatgtgttaatttgaaaatgagataatttgaaagttaatctcaggattattaaaagttatctcattttcttctttacaaaacattgacatattttcaaattaacaaattttcaaattacgatcatgtatacagaattaaccgaagatacattacaaaatatagtgaacgacaatgaaaaggtagttgttcagtatggcgcgacatggtgcggaaactgcagaatcatgaagccgaaattcaaaaaattagccgctgaaaatgattctatcccttttttatatgtagatgcagaaaagctgcctgaaagcagaaaattagcaaaagtagacaacttacctactttcgccatctttaaaaacggagagcttgtaaaccaggttcagtctaaccaggcagaaagtttaattaacctttttaatgaattagcataatgaaattacccgtaatcagacagttttatcagaatcagactcctgaaaaccttgaaaaaacattagaagtactggaaagtttctgcgagttcagaggaacaagcgaagaagacttaaatgttgcaggagaattaatcaccaacatttgcggagctttagaagttcacgccaatgtacaaaacggaatgagtgagaaagatgctttaaactcttttgctcagaaggttttaggatcaattgacaaataatcttttgataattctatcaaaaaaattataaaaacacaaaatacaatacctgaggtttttcctcattactatacttttttctattctttaagaatctttatttcaactgtaaaatgtacttcgaaggaccgtaaccggtcacatgaagctggaagttgtatggaaaattttaaagaataaccaataaaatcccggtgatatttttcatcaggattttttgggtttaatttcccaaaaccacaaataacacaaatgatttcacaaatttcacaaatacgacagaacagttgaaaaggtattcatcaaaaaaaacacatcatcactgtgtcaatctgtgaaatccgtggaatttaataatcataagtttcggctaaagcctttggatggaacttatttatgtaaacgggctaaagcccgttcctattgaattagtgttattcgtgaaaaatatttgtggcattagtgttcaacccattaaaccacaaataacacaaatgttttcgcacaaatttcacaaatattaaaattcgtttttttaaaaaatatacgcaatcatccatgccaatctgtgaaatctgtgggattaaataatcaatataattataaatttcagctaaagccgttggaatgcctcccattcctattaaactgttaattggcgttattcgtgaaaacatttgcgacatttgtgtttaaataaaaaaaatcccgatgaaaaatcaccgggactattataaaaagatctttatatgttagtttcttctgctcatcagaatactcagaatataccagaataaaagcataatagaagcaaaaagctgcaatgccgctcccacatactgattggtaccataagagtctttcagtttacttgtctgatacagaatagtagctgaagctaaaatcaccattcctactgaaaaccataacccaaggttaaaaccgaagatcattcctcccacaatcagtccgatggaaataaaaccaccgattacaataatgtttcttaagaaagaaaaatctcttttagaagtaaatgccacagcagaaatacctgcaaacatagcaatggttaaagtagctgcctgaaagattacattagccccgccttggatattggtagcaataaaaagaagtggcataaagataattgcttccagcaaaatgtaaaatcctaatcctaaatactgagtagatttgctttgagaaagcgaccatttggaagctaaaacagaagccagccagaaaactccgataatcagcagccagatatatttctgactaaacatcataaatataatttcctgcggaaccgttttcaataatattgtttccactccaataaatgcaagaatcgataatgcgacatgcaaatacgtcttcttgtaaaaatttgccttctccacctctgaagaatgagcaactaaaacatctgtcatcatagttaatatttttttgttaatcgaaaataaattaagccttatttcgagggcaataccccaagaatttttccatcatcctcaaatacagcggtaataacttccttggaagatcctccctcatatttatatttaatacttggatgactgattccgtccattgttttataatatccggcctttaagacttcaagttttttgttgggatcaataccatctttgacttttttaagtacatcatccgtcacaatttcctttaccttctcagaaatcaatccatcaatagccgtacggtctgaagcctgtaaagctacaacgaacttctggaagttatcattatacaaactgaccttctccttacttatagtagcctgcacttccttttcaggactgtttccaacctttgcaccggttactttctgtgcaaaaaccagctgcccgccaacaagcgccagtcccagcaataattttttcatagtattcatttttgttctggtgaaataagtgatggaagatacgaaaatcagaccagttctaaaaatttcattgtatctacattatctgcgtaggtatcaagacccggattttgtgcttccccaaacggaattgcattcattcccaactcctcctttgccactacacactgaatattttcttcattttctgcgataaagtttttcacatcatccaaagattcatatctgctgaaattaatcacagaaagcggactgaacagtttttcatcctctttcagcatcacaaaattattatcccagaatttatcctgattcaaaagataaaccgctctgttataatcataattattggcatatttattatgattgatgatatcctggaatcctaagaaattctcaaacagcctgtcaatcacaaagtcctgcggaataaaaattctcgtcacatttctgcatcccaatccgaaatactggaaaatatcttttgccagcaattgcagttcctcattcgtttcatcacccttcagcaccgcaacagaagttctgttcttacggataatgctcaaatgatttttgaaataatactccagatatcttgctgtattgttacttcctgtcgcaataacggcatcaaaattctctaatttttctacaaattcaaaaggtatattcccattggaaaactcgttccattttttaagtaaaaacggaatcatatatttatcttttgaagacagcttaatcacaggaatatgattggccagaatcactgaaattacatcatgaaatcccaccaaaggaatatttccggctaaaataagtccaactctttttgaaattttagaaatggaataatgggccagccagtttctgatgttatcttcagtcagaagttctgcccattgctgtaaagcaaatttctgattatcaacggtaaaccacggattctctatttcagatctttttaacaataattcaatatcagcatcatcttcattgtgatcctccggtttcttcgctaaaaacgcttttatataatcgcttaacttaataagtcctaaaacttgattttcggtattcataattactttaaaattgggtaaaattttgtaattttgtgcaaatttaaaaaaaattagcgatggctattaaaataactgatgaatgcattaactgtggggcttgcgaaccagaatgcccgaacaatgcaatatatgaaggagctgtagattggaaagcttctgacggtacggctcttcaaggtacaattactttgccgtcaggacttactgtagatgccaatgcaccacaggaacctgtaagtgatgatgtatatttcattgtaacagataagtgtacagaatgtaaaggattccatgaagaacctcagtgtgcagcggtatgtcctgtagactgctgtgtgcctgatgaggaccatgtagaatctgaagaagctctgcttaataaaaaagcattcttacacggtgaataaaaaacttccgtctcatgatctgtgaggcggtttttttgtccaaaaatcccaaattaaccaaaaaataaagctaaaggaatctcaaatccggaagcaaccaaaaaataaaaatatgagcaaaaagcacaacttcagcgcaggaccatgtattttaccacaggaggtatttgaaaaatcagcacaggctatcttagactttaacggtatcggattgtctctacttgaaatttcccacagaagtaaggatttcgttgcggtaatggacgaagcgcgtgccattgtaaaaagattgatgaatcttggtgatgattatgaagtactttatctgggaggaggtgccagcctgcagtttgcaatggttccttataacctgatgaaagtaggtggaaaagcagcttacctggatacaggaacatgggcagcgggagccatcaaagaagcaaaaaaagtaggaacagtagacatagtaggctcatcaaaagaagagaactattcttttatccctaaagattatacagttggatcagaatatgattatttccactgcacttccaacaatacaatatacggaactcagatgaaatctttccctgaagtggatacactaatggtttgtgatatgagctctgatattttctcaagacagctggatttttccaggtttgacctgatctatgctggtgcccagaaaaatatgggacctgcaggagttactttagtagttgtgaaaaaagatatccttggaaaaacaggaagagaaaacatgttttctatccttgattattcacagcacattgctaaagaatcgatgtacaatactccaccggtatttcctgtgtatgcctctttacttacccttcagtatcttgaaagaaacggaggaattgctgctgcagaacaaagaaatgaagcaaaagccaagcttttatatgatgaaatcgacagcaacccgttattcgaaactttctgcgtaaaagaagaccgttcactgatgaatgtgtctttcagaattacagacgaaagtaagaaagaagagtttgataatgcatggaaagctgccggaatcagtggcttaaacgggcacagaagccttggcggctacagagcaagtttatacaatgccctgccgattgaaagtgtacaggttctggtagatgtgatgaagtcgataaaatagcttatattaggcgaccgaaaaataaaaagatatcagacagcagatgtcagacaacagacctcaaagtttgatttctgacatcttgtatctaacatctataaaaataacaaatgaaagttttagcaaacgacggaatctcaaaagcaggagaaaacgctctgaaacaagccggaattgaaattctggacaatagagtggcccaggatcacgttattaattttatcaacgataataatgtgactgttcttcttgtgagaagtgccacgaaagtaaggcaggatctgattgatgcatgtcctggtcttaaaattatcggaagaggcggtatcggaatggataatattgatgtagaatatgccagaagcaaaggcattaaagtcatcaatacgcctacagcatcttcaaaatcagtggcggaattggttttcggacatttcatctcactggcaaggttccttcatgaatccaacagactgatgcctctggaaggagaaacgcatttcaatgcgatgaaaaagtcattcagcaatgcgcatgaactttcagggaaaacattaggagtaatcggctttggaagtattggccaggaagttgtaaaaataggaattgctttaggaatgaaaataaccgttctgacaagaagtccgaaaacagaagttctaacactgaatttcttcgatggacagtcagttaactttgaaatcacttccaccaatgatatggaagcattccttaaagatgccgatttcatcagcatcaatacgccgaagacgaatgaatatattctggacacgcctcagtttgaaaaaatgaaagacggagtctatattgtaaatactgcaagaggaggtgtcatcaatgaagtggcactgattgattttattgaatcaggaaaagtagccggagcggcactggacgtttttgaaaacgaaccgaaccccgaattacctttgctgatgaaccctgcattatcactttcccctcacataggcggaaatacggtagatgcacaggagaaaatcggtatcgaacttgcagaacaaattattaagctacaaaaagaaactataagataaatatgcctgtttttaaacctttccgtggaataagacctcatagagactttgagagtactttccctacccatccactggataatttcacccaggaagagattgcagagaaagctcaagttgaaaatacttacatcaatatgatcaaaccctatgttgtaagtaaatccaaagatattgaccggaacctgagaaagatccgttctacatttgaagaacttctggaagaaaagaaattagtccaggacaattcagcctattatctttatgagcagatctatcccaacaaacagatgttcagaggacttctgggattggcaagtattgaagatttctggaatggaaaaatcaaaagacacgaaagtaccattccgcagaaaaaggaaaaactggctcattatcttgaaaaagtaaacctgcaggcagaacctgtacttcttacctatccggccaattcaaagattgaattgctgatgaaccatgaggaaaaaaatgttcctatcttcaaccatgtggattcgcttggtatcagacacaaaatatggagaattgacaatcgcctgaaacttcagcagtttaaagaagtaattgatcagattgattctttttacattgctgacggacaccacagaatcggatctacagcattaaatgccaaataccataaagagaaaaacaaaaaacataacggtacagaacattacaactttgtatatagttttattgtttctaaccagtcgatcaagattcatgactataacagaattttacatgatctgaatggaattgctccggatgatttcctgaagcagcttgaacaatatttccttattcacgaaaaaggagaaacaccatactacccttctcaaaagttccacatttctatgtatatggacggtaagttttattctcttcacgtaaagcatgaccttcgttccaaggaaatgtctctggacaatctggatcaccaccttctggacaagtatattttcaaaaatattctgaaaattgaagatccggacagctctgagcttatttcttatgtaaaaggaacctccaatatcaacggaatcaatattttaaaagaaaaagtggataacggtgaaggtaaagtcggtttcggaatttaccctgtgagttttaatgatatgattaaaatttcagacttaaaactaagcatgcctccgaaatgtacattcattgagccaaaattgattacagccttagtaatgtatgatatgaaaccttaataatttcctattttttccctaattttatcaatggaaaaagaaaggtaaataataaatgaaaaaaatattcattatacttccactctttttgagtggatttttattttctcaaaaaaagccacaaaaaagtccggcaaaaaaaggaacggttgccaaattcaattatcatgatgagttcagaaaaatttcggatgaaattatgaccaacggcgctgcttatgaaaatctgggagagcttaccaaaggaatcggaccacgtttcagtgccacaccagggtattcaaaagccgtagaatgggcagaaaaaaaatttaaggaaatcggcataaacatgatctggaggcaggaagccaaaaccccggattggatcagaggaaaagaatccctgcagataaaagccggaaacggagactggaaaaatatcagaatgctttcttttggaaactccgaaggaacaggcggaaaagacctgacaggtgaaattattttaattaattccacatcagagcttaacgctatgtcggtagggcaattaagagacaaaatagttttcgtaaatgttccaatggacccgaaaattatcaataccagtgattcctatttacaaactgcaaaatcaaaattaatttccgcatctgttattgccaaaacaggcgcaaaagcattaattataagatcattaacaactgccaatgatgatactccgcatgccaaaatgatttactacgaaccggatgataaaattaaaattccggctttgtctatcggagtaagatctgcggatgaattggagaaaaccctgaaaagtcaaaaagttatcgctaaaatcaatatgaccgcacagtcaaaaagcgataccaccaatcccaatatcattgctgagattcagggcaaaaaagattctaaagtaattgttttaggtgcccagcttgattcctgggatgttggcgaaggcgccattgatgacggaacaggtgttgtgcagtgtattgaagttttaaggacgttgaaagcgcttggatacgaaaataatcacaccatcagagtagttttgtatgccaacagtgaaaacggaggacagggccgcgaaatgtacgccgcttatgtaaaaaagaaagaggaaaaacatgtatttgctttaggaactgatgccggaggatattctccgagaggattttctttagacatgtcgcctcagagaagaagactggtatatccatggaaagaatattttcttccttacggagtttatgattttgaccagacagaggctattcaggacatttcacccttgaaaaaacttgatattcctctggcagagctcgttgtagatacacaaagatatttcgactaccatcattccgaacaggatacttttgataaagtaaataaaagagaactactgctcggagcggttgccatcacacagatgatttttatggttgataaaaactggtaacaatgaaaaagatattaggaacatcattattactttttggaatacttgctttcggccagtctaaagaagattccattcagttcagaaaaatttccacagaaattctgaacaacggaaaaggatataatgaattaagagaacttacccaaacaataggcaatcgtttaagcggttctgaagcctacgaaaaatcggtacagtgggcagcacagaaactccgtgatgccggagctgataaggtatggcttcaggaagtcatgatcccggtttgggtaagaggaaaagaatctctgcatattcaaacctccagaggaaaatggaaaaacatcaaaatgctttcgcttggaaattctgaaggaacaggaggaaaagatgtttcaggtgaaatcatcatggtaaaatcactggaggaatatgatcagcttcctgccgaaaaggtaaaagataagattgtctttttcaattacccttttaatcagggaaatgtacagacatttatttcttaccgtgatgcaagtgcttacagacggactgcagcttctttaacggctaaaaaaggaggcaaatttgccattgtcaggtcactttcttcagctttcgacgatgttccccacaccggaaacatgcgttatgatgaaaatattcccaaaataccggctgtaaccattggaaatacttccgctgatgagcttgaagcgttattaaaaaatcataaggttacagctaaactcaattccaactgcggaatgaaaggtgagaaaccctcccactctgttatcggggaaatcaccggtaaaaaagatcaaagcgttattgtggttggcggacaccttgattcctgggatgtaggtgaaggtgcccatgacgacggagctggaattgtgcagagtatcgaagtattaagaacctttaaaaaattaggcatacaaaacaaccacaccattcgtgcggtttgctttgccaacgaagaaaacggaacaaaaggaggaaaacaatatggcaaaacagcgaaagaaaacaatgaaaaacatctttttgctatagaatcagatgccggaggcttttcacccagaggaatttctctggaaatgaatgaccctcagagaaaccagatcaaaggctgggttaatctgttcttaccatatggcgtctataactttgaaggaaaatattccgggtcggatatcgctccgcttcacgaaatgggagttcccactgctgaactggttccagatccacagcgttattttgatattcaccatacagaggaagacacttttgaaaaagtcaaccgaagagagctgctgctcggtgctgcagtaatgacacaacttatttatatgattgataaaaattggtaaacaatgaaaaagatattaggaacttcactattactttttggaatgcttgctttcggccagtctaaagaagattccattcagttcagaaaaatctccacagaaatcctgaacaacggaaaaggatatactgagctgagagagcttacaaagaatatcggacatcgtttaagcgggtctgaagcctatgaaaaatccgtaaaatgggctgaacaaaaactccgtgatgccggagctgataaagtgtggcttcaggaggtaatgatcccggtatgggaaagaggaaaagaatccctgcacatccaaacttcgaacggcaagtggaaaagccttaaaatgctttctcttggaaactcggaaggcacgggaggaaaagatgtttcaggggaaatcatcatggtaaaatctatggaagaatatgataagcttcccgcggaaaaagtgaaagataaaattgttttcttcaactatgctttcagccagtctttcatagaaacctttaaggcttatggtgatgctgccagatacagaactacagccgcttctctgacagccaaaaaaggaggtaaatttgctatcgttagatctctttcttctgcatttgatgatattccccacaccggagcaatgcgctatgaagacaaggtttccaaaataccggctgtagccatcggaagtactacagcagacgaactggaagcattattgaaaaatcagaaagtaacggcaaaactcaattccaactgcggaatgaaaggtgagaaactctcccactctgttatcggggaaatcaccggtaaaaaagatcaaagcgttattgttgtgggcggacaccttgattcctgggatgtgggtgaaggtgcccatgatgacggagccggaattgttcaaagtattgaagtattgagaacttttaaaaaattaggaattcagaacaaccacaccatcagggtggtctgctttgccaatgaagaaaacggagtaaaaggcggaattcaatatggtaaaacagtaaaagagaaaaatgaaaaacatctttttgccatagaaacagatgccggaggttttgcaccgagaggaattgccctggatatggatgatgccaaaagaaaccagatcaaaagctggtcaaacctgtttcttccttacggagtttataattttgaagaacggttttcaggcaccgacctctacccgcttcataacatgggaattcccgcggcagaactgatgccggattctcagcgttatttcgatattcaccatacagaagaagatacttttgaaaaagtgaaccgaagagagcttttactgggcgctacagctttgacacagattatctatatgatcgacaaaaactggtaaaataagaaaccgtctgtaaagacggttttctttttaaacactgttgataaatcatcaattcaaatatttttccctactgattttgcagatgtgcacagatgatcatgcaaatcttttaatagcttgattcgtatgatactatttgtggaatttgtgtaaaaatattagtgctatttgtggttatgattaaacacaaatgacactaataatttcacgaataacaccaatttcataaaactcatttattcaaataaattaaaaataagttgaaaacagtattctaatcattagttctatccttaaggacacaagcttcatgcttaacttttcccatcatattataaatatgaaaaacaatttctccgtaatattttctttgttgtcattaataacacctaagtattagaaaatttttctacgtttaaggaaataacagaagaaaacacgcgtcactactgatctcatcactcccgtgaaacaaagtgttaatcgcataatctgaactttggcataatattggcatgtaaattatggagaaaaaaaataaaaaaacactaaggatgagaaaaaaggttttctgtggattttcagtttttccactgattcaagttcatatgtaaatatgaatccctttttttctacgatgccgtaaaagatacgggcccctgatcaactaacccccattagtttttcatagcagttttgcacccgtatctgactggtatcacaataaccaggaatcatttattgattcaaaaaaacaaaatatcccggactttcagcccggtatcataatataaataaacggcaaagtcatcgtgaaccttagcccagtaaaagaatatattctttttaccgtgatgagtgcgcctttatgacataaattaatgtataacccttaaaatgttagtaatgatgagagcgttttttgaaatgatttttaagagaaatgaagatgctgcgaaattgcatatatggagcctaatgctggtgttgagttttgctgcattttctgtgttggtatacgccacgaaaccaagctttaacagcttaattatatatctgacggcatttgccgcttatatcgggtttggccttgtattcatcagttccctggccggaacacgtgtgaagaaaagataacagaacatataactttcaatttatttttacttgggaaaccgccctgtttgggggcggttttttattattcaagttatttaaaaaatatatttttcatttccaacaaaaaaagccactccttccggagcagctcccgtgataacaacaagtgctatcatcacatcgtaaaaatttattctttaaacatattcttcagcattttttcgaggatcttctgggtttcttcctcgatcatttttccggatttttcaaccattttttccctgaaaggctcacaacaggctttgataccgaagccttcatctattttaatcagttccggatgaagattgtgcgtttcacatacctccgactctatttccttttttatcccattgtaattcagatccaacatatttattttgtttcttataagtgccggataaagatagaagtaataattccttaccgaaatccgtatttttacggtatttgtaggaaacaaataaacacttcttcatagacagctttatttttaatacaaaccaacacttactgcttgactctttaaaacttatccagaattttcttcggtaagattttcaccagttcttttttatactctttttcaagaacaacaaatttccatgcctttttatcttttgcaacagcacaggctttcataccagcgttgatgagataggaaccttcgttggctacatatttcacattatctgcaccgtacttagctgttaaggcaccgttcattttctttttcatgtcatcatttaatgaactgacgttgcatttcagtttcaaaaagtaatgggtaatagaaaagtattcaccggtaatgagttcaggtttctcaatagttccaaattttaaatcatgtacttcaattttcatgaatggattattgtaagtcatattcaaaatctgagtcatctgctcttttgaaactatcgtgaagaattttggatatatacagcttaccgcctgatcgatctgtttggactgaatgctgtttacaaaataagtaagtgatttttttatcgcggcatcgtccggatttgccctggtctgtgaaaaagccataaaagacagcataacgaacagaagcagaagtgatttggttttcatgattgaagggtgttacatttttgccagaaaaattattaaactttccaactgtaaaatatgtcgtgatattgactcagatcgttacagaatattttgagcaaaataaaaaagccatcctttcggacggcttttaccatattttgaagattcaattattttacttttacaagctcaacatcgaaaaccaaccatgagtttggcgggattacccctcctgctcctctttctccgtaagccatcgccggcggaatcaataatgttgctgtttcaccttctttcaataaaaggatcccttcatcccatcctttgattactcttcccattccgattggaatttcgattggctcatttcttttaaatgaagaatcaaactcagttccgtctactaatttacctgcatagtgtacggatacattgtcaccagcttttggagccttaccgtcagctgtttttgtgattttataataaagaccggattcagttttctgcataccagctttcaggctttctaccaatttctcctggttagctttgaattcttcttcttttttctttctttcagcttcttctttagcgatgaaagctttattgttttctgcgattttagcttttccttcgttgaaagttttagctgcatcgtagtgtttgtactcgtcacctttactgaaaacagatactttttctaaaacgatatctgttttaggcttatcctgagctcctttttcaacgttagcaatagcatcaatcacttcagtcccttttactacttttccgaagatcgtatgtcttccatccaaccaaggagtagctacttcagtaataaagaactgggaaccgtttgtgttaggtcctgagtttgccatagaaaggatcccttttcccgtgtgcttaaggtcatttctttcatcctcgaatttatatcccggatctcccatacctgttccctgaggatcacctccctggatcatgaaatctttgattactctgtggaaaatagttccgtcatagtaaggaactcccttagccttagctttgttatcgattttcccttctgcaagaccgataaagttggctacagttactggtgctttcttgtcttcaaacttcacaatcatatttccttttgtggtttgaagattggcataaagtccgtcattaagaccttcgtaagtttctttgtctacgttcatttttttataaattggggtacaactcatcagcgaaatacttgccgctgccagaattatattcttgttaaacaatttcatgtattatagagcttttaattttatgattaatggaatgtcgttgtctattttcttttcgtctccgtaggttccgtaagccagtgaagacggtaccaaaagcgttacttcctctccatcccgtataaaacgtaaagcattctccaccgctttcagttcatcgaaatgcccgaatctggcatctctcctttcaaaaggcttgtcatagattttagtctcatcaaaatcatacagatcataggaataggaaatcatggtctcatctttccttttttctctctgatcataaccttccaccgttacccagtaattaagctgcgtaggataatactttacagactggccattgatccagtcctgaatctggccccgttctatagtatttaaatttttcatcctgtttttggaaacatccagatctttctggcttaaaacaccgcctacaggaggatgagccgtctgggtatttctgttgcagctcaacaggcttatggctgatatgaagagtatttttttcataaacttttgcgaaaatacacatttcgcgaatcaattacaaaacttggttaagaaatgtgtgaatgtaataaaatatgaatctaatcttaaactattcatacatttttataaatacatagatacaaaaaagccgggaaaaacccggctttcatattattatttatcagctattatactgtttccaaagcgtggtctacaataactctccatccgaaaggatcttcagacaggttggtttgtaagtctacaaggtctttctttaggatcgctgcaaaactttcctcatcagataatcttggaagatcaagtttttctccctggtaccctaaagcctggaactgagtggtaactacagccgtacctactccccaaacttctttaagggaaccgttctttaaagcctcaattactgtttttacagcaataggctccacttttacttcgattcctcttctttttgccagctgaataaagctgtctcttgttactccatcaaggattttttcagaagtcggaggtgtatagattgtatcattgattcttacaaagacgttcattgtaccactttcttcgaaatattcgtgggtagcatcatctgtccagataatctgctcatatccttcttctatagccaattgtgtaggatagaaagaagcagcgtagttccctgcagcttttgcagaacctactcctccgtttgcagctcttgaatagtggtcagaaattttcactgataccggttctgaataataactcttcgctggcgttgcaacgatagcaaacatatatttattcgaaactcttgctttcaaagcttcttctgtagcaaaaatcaaaggtctgatataaagagacattccttccccctgtggaatccaatctctgtcgatatctactaatgcttttaatccgtctaaaaacatttcttcagtcacttcgggcatagcaagacgcttcgctgacttattgatacgttcaaaattcttttcaggcctgaaaaggaaaacctgcccgtctttgtctttataggctttcataccttcaaaacaagcttgtccataatttactcccatcatagcaggtgtaaatggaatcggaccgtaaggaactaattttacatcaccccattttccgttttcatactcacaaatgatcatatgatcgatgaaagtatttccgaatgaaaaattgttagggtcaaatgtagaaattctggagttttcagttttttgaattatcattttttaaaatttttacgatgttctacaaatttaacataattttctaaatataaaaattttagagtaaatttgacaaaaaaatagcttgaaaagagaaattaagaccacaaacgacggtagtaaaacattgtttatcaatgaattaaatgaaaactaccattctcatcacggggcactacaggaagccgaacacgtgtttatcaaaaatggactaaatttgataaatgattgcgaaattaatattttagaactcggttttggaacaggtttgaatgttttggtaacaattaatgaatatttaaaaactgacaaaaatcatgtcatcaattatttttcacttgaaaaataccccataaatgaatccgaagttaaagatttagcttacgatgaactttttgataacccagagttaaaaaaaatttatcagaaaattcatctgtcagattgggaaaagtcagtagaaattattagtggattcaacctaaaaaagatagaatgtgatttttttgacctgaaagacattgatctgcctgaaattaaccttgtctacttcgactgttttggcgccagagtacagcctgacctttgggaaaaaccgttatttgagctggttgctgacaaaatggccattaacggattattaacaacttattcttcaaaaggcagcgtaagaagaattcttcaggaattgaatttccaggttgaaaaaaaacagggcccgccggggaaaagagagatgattaacgcagtgaaactgtaaaaggcaaaggggcaaaattgctaaaaggcaaaaactatccagaagcggatcttcaaatttgcttttcagctattttgctttttccctatttcgccttttcacctctgtaaaatttccttacattagctatacaaaatattatacattatatatatgatagataagatcaacattagagtgtatgcatgtgcggtaaaagataagcaggttttaaccttatttgaagaatatgccggcgaacctttaatgaaatttccgggtggcggactggaatacggagaaggtgtactggaatgcctgcatcgtgagtttgatgaagaactgaatgtaaaaataaatgtactggaacatttctacacccaggaaaactttctggtttcccgtttcagagaaaatgaacagctgcttaccatatattatattgtagacatcatcaatgaagaagattttattattatggatccctgtattgaaaaaacagaatggattgatattgacagaccggacaatcctttcccgcttccgatagataaaattgtatttaataaattaaaagaaaaattcctgtaagtaatcttacaggaatttatattatttctttactttaaaatcgcttgctcccgggtaaggctgtaaataacctgagttccagttggactgcagcagtgattctataaactcatcacttctgttggtatgagggtcataacgttctttcagatcaatatcagccatttttccttttacattccaccagaaagcgctccatccacctctaagttctttgataatctcaaagacatttttaccggtagccctgttcatcagttttgcaaaaacctgtccttcggtagtagtaagatctctcagttgtttttcatattggtcagccagtatattctgtctctctcttacaaactttctcttggctttactatccatatcattcatatctttctgaatatccctgtactgctgcaatgcggtaacaaataacggatataccctatagagctttttatttagaaagtaatagtaattcttatccagctgattgttaaaccttggcttgttcaccaataccagttcatctaaaacaacgacaggttctccattgatttcataaaccttaattttctgctgctcgtcgtaataatatttattaccgaattcgtccactttcagagattcgggcgggtactgattgagaggttttgccacaataccatccttctgaccgaaaacactgactccaaaaaagagaataaaaaggcagataatcttactaaaattcattatttttacacttataagaacaaaaattaaacgcaaaaatcattcctttttatgaaatttgaaaagaaatctttgaaatttttagaaaaatacctaaacacatcatcaccaacaggttacgaacataaaggacaggaagtctggatggattacatcagaccgtatgtagataagatagaaatagaccattatggaacctgctatggaattattaatccggaagctgaatttaaagtagtgattgaagcgcatgctgatgaaatctcatggtatgttaattatattactgacgatggattgatttatgtcatcaggaacggaggctcagaccagaccattgccccttccaaagtggtacatattcacggagaaaacggaattgtaaaaggggtattcggatggcctgccattcatacaagaacaaaccagaatgagccggctccaaaaatcgaaaatatttttatagactgtggcgctacttccaaaaaggaagtggaagaaatgggaatatatgtaggatgcatgattacttatcctgacgaattctttgaaatgaacgaccgttattttgtgtgcagagctttggacaacagaatcggaggttttatgattgctgaagtagcaagacttttaaaagaaaataagaaatcaattccttttgggctttacatcactaattccgtacaggaagaagtaggcttatatggagcagatatgattgctgatactatcaaaccgaatattgccattgtaacggacgtcacccatgatactaccacgccgatgattgaaaagaaaaaagaaggtgatcagaaatgcggcgcaggtccggtagtattcttcgctccaagtgttcatcacaccatcagggagctgattattgatacggcaaaggctaaaaaaattccttttcaaagagctgcagccagcagagctacaggaactgatacagatgcttttgcccattcgaacggcggagtaccaagtgcgttaatttccttacctttgcgttatatgcatactacggtagaaatggtgtctaaggaagatgtagctaatgttattaaacttatctacgaaacggtccttaaaatcaagccggaaatgaaactgaaatatcattaaaatgaactcaatttctgatttaatcaaaaagccaacttttatctctattgtatttatcatcctggccgtacttggaattcctttaattgtctatcagttattgaccattcctgaaagcgggagcctgggagttacagtagaaataattttcctgttggttttgttcggattttttgtaatcgacaggtttttaatcagaaacattagctataaaaaggtatccatcatagaagtgatgataataacaggatatctgacttattattatttcaccaatgaccgttcattttcaataggataatataaagtaaaagtataaaaagtaaaaatgaaaacgaagcttattgctccatcccttttatctgcagacttcgggaatctgcaaagagacattgaaatgctgaacaattctcaggccgactggttacacgttgatgtaatggacggcagatttgtacccaacatttcatttggttttccggtaatgaaaaccgttcagcagcatgctaaaaaatttgtagatgttcacctgatgattgtggagcctgaaaaatatgttgatgaatttatcaatcttggtgcagaccttgtttctgtacattatgaggcatgtacccatcttcacagaaccattcatcatattcagaataaaggggcaaaagcaggtgtggttttaaatccttccactccggtgttaatgcttgaagatattattgcagatgtcgatcttgtattattaatgagcgtaaacccgggatttggaggccagaagttcatcgaaaatacctataaaaagattgctgaaaccaaagatctgatcttaagtaacaattctacagcacttattgaggtagatggaggtgtaaatcttgacaacgcttctaaattatttgaagccggcgccgacgttcttgttgcaggaaatgctgttttctctgccgaaagcccggaaagaacaatcgaacttttaaagatttaagattatcttttatcatacacaaaaggcagccgttggctgccttttctcttgtttggaaacttaagtcgtcttggttataatctttttttcaacttgttgaaaatgtttaaaactgtcttactaacaagacaaagatctgaataaaatcacacgtacgcatccgtagaaatactgaatctgacatttgcgtatttttacttaatttcatttataatttttatatttccttattccagacgcaggcacagaccacaaaaatgatagaaatgacagaaaaaacagttcttatattattcaggaaattccatctgttttcaaaattttcccgcatctgtctgatcgcttccgtagtggaacctgtaatatcaaacttatccagtgcatcattcatcggaacatttccggcaaccgtaaccccaaaaactccaatcaggtaagccaatgtagccagaaggagaaaaataaagacagactgttgtccacgaaacaaaaacgttgaaacaggaagcagaactacagtacccataaaactcataaagaagacaggattaaggatttccctgttgatgttctgcatagctttcaggtattccggatcagagagctttcccagcccgaggaccacagaacatgaataagcataaaaaagtcctcctatcaaagcagtgagaacagcggtaatgatcaatattaatgttgtcattttcatataatttgattttggttatcagaatagaatttaataaggattccattttttaatgatgttctgcgctgtaagaatcatttcaggatcccagttttctgttttgaaataatgaaaatcatgatttttaataactgcagcatcagcattttcaaaaagaagcttagtaagctccgactgttcttcatacagcatccaatcttccaaaggcttctccggaagtatcatttcttttttcatccagctcctttctgacagtttcaagtcggatatttcaataatctttctgacagtatgaaaatcattcaggaaagaaactttttcttcttccgtttttacagtatgcccgagtctttcaataataatatattccagattttggcattgttccattacagagggtaaaacagaaagaatatcctgcggaatgacgtcatcatgagtatctctcctcacctgctttttcccgtaagcactctcctgccagcttcctcctgaaagatgaatctcttttaccttatccagagggtataaatcaacgatcgctttcatttctaccccaaaattgcaggattgacaataaatattatggatatcaagaatcagaaagccatttgtatcttctgtaagctgatcaagaaatatcccctgctctttaacatcatctatagaaaaagaaaatgccagattttctatcccaacaggaatatccactacatcctgaagtctgcaaagcctgtcttttcctatttgtaaagtttttggatgcagagagaccggtaatggcactccctgatgaaaattttccgtattcatgaaaccaaaatgttcagtaatatggttgtaattccggagcctgacttcttctttaagctttttcagccattcatcctgtctttctgtccatcttgcatcaaacaaagaatagtaaacaccatgacctatcaaacggccgttctctgcgtaaaagtttaacaaatcacgaagccagtccggttcatttggatgataaagggtatcaaaagaccattccaacacatcaatggaattattctgcagcaatggtaaaatagcagaaacaaagtctgcttctgccatcattgatactcccagcattggctttctcatctcctatcccattccgcaggccgggcagccgtatccatgaagcacaagtgtatctttttttacgaccggtttaggagttcccggttttttcttttcagccgtatccgaagcagcagctttccttacttttttaacaggcttttttgttttagcggcaggcctggtagtctgtgcagatactcctaccgctaataaacttgccattaatattgccggaattttcataattgcttttttcaggtaaattttacaataaacgttccatttctaaaaatacaataataagaaactgtttgataataattattgctaaatattaaaactattttatcctgtaatgttttctttatttatatttaatgttaaaataaatctatatatgaaaagcagtctgattaaagctgttttcctgggaatgatattatctgcgggtactattggtgcacaggagcaagcagccggcaacagcaaaaaaatggaatggtttaaaaatgccaagctgggtatctttattcattggggaatttactccgtcaacggaatctccgaatcctggtcattcttcaataattacattaatcacgaaaattatatgaaacagctgaatggtttttcagcttcaaaatatcaaccggaacaatgggtaaatctcatcagggaatccggagcaaaatatgcggtgataacaacaaaacatcatgacggagtttcattgtggaactcaaaagcagaaaaagcgacaactattcctcaaaattcactggcacaaaaggatgttttaagcccttttgtttctgcattgaaaaagtccggattaaaaacagggctttatttctccttaccggattggagtcatccttattatgatatcaatacccggacaaaaaagcgttatgaactcaaaaacgatcctgcacgctggcagcatttcatcagctattatcagagccagcttaacgaactttcttctcagtattctccggatcttctttggttcgatggggactgggagcatacttcagaggaatggcaggcttctcagactttagatttgctcaggagacacaatcccaatatcattatcaattccaggctcaacaatcacggagattatgatactccggaacaaggtgtcccggtagttccgcctcagaatccttattgggagctctgctataccatgaatgattcctggggataccaaccctttgacaaaagttataaaactcctaatatgattgtcagaacgctggcagatgtaatcagcatgggaggaaatctcctgcttgatatcggtcccagatcagatggcagcattccggaggagcaggttgagattcttaaaaacctgggacgctggacctcaaaaaatcagcatgccatctatgaaacaacccgcggaattccttttgaaaattacaaagggaaatcttctttgtcggtctccaaaaaatctttattcctgtatcttgaagaagccaaaaatttcacaaagatctatggactggcgacaaaacctctttcagtaaaaatcatcggagaaccatccgctgttgttaaaacggattataacactgaaaaaactctgacattgaatttctccgatgtaaaatttgacaaagatgtcacagtggcagaacttacttttgacacacctcctgtgtttctcaatgattttaaaaagaaagaaaatctccttgctgaaatgctggaaaacaaaaatacccgggaagcagtttatgatttggccaatgccttacataatggtaataatctgatcacaaatgcaggcttaaccaatgatggcctcgacatgaaaatcaaaaaaactcctgcaacaaatccggaaacgctgcaatggataagcaaacatgcagaagctttatttgaaacaggaaaaggactgccggaaggtcattttccgggaatgagtgctttatcaaaagacaaacagacactttatctttttgtggaaggaattccaacgggaccaattgcactgaaaggaataaaaaacaacattgccagaataagaatcgcaggggaaggcagcatgcttacccataccatttacaataaactttactggagtgacaggccgggaatcatttacattgatattcctaaagaaagactggacaaacagatgaccgtcattgcagttttgcttgataagcctctagagctgtacagagaaaacgtaggagctattgaaaataatctttaataagccgctgcacagaaaaacaaaaatccggagaaaattctccggattttttattgtataagatgattttcttagaaaatctctcttcctgaaaaatggaattgagcttcgattaatgcattctcgtcagaatctgaaccgtgaacagcattttctccgatgcttcttgcaaacatttttctgattgtaccttctgcagcttctgcagggttagtagaaccgattaatgttctgaagtcttcaactgcattgtctttctctaaaactgcagccacgataggaccagagctcatgaattctactaattctccataaaatggtctttcagcatgtacttcatagaatttttttgcatcagcaactgtaagctgagttaattttaaagctttgatcttaaaacctccttcagcaatctttcccaatatagcaccgatatgtccgtcagcaacagcatcaggcttaatcatagtgaatgtaatgttagacataaatgtatatttttttaatggcgcaaaattacaaaaaatatctttgatttttattttaattttttttaacataaaaataacttttattaagaaatcatgaactaaactttggcacagtaattgtttattctattgcgattctcatgtttaatttgagttttcatggttattagtttttacccagcttcggctgggttttttatttcaaaaaaaataccacatttttttactaattccataattttcaacaacataaaaagtcatataaaataattttgtcattttttttgctattattgcaatagtcaaaattacccttagtatcatttttcaagctcaatcagaatgtgacaaaattggagttatttatgagaaaggtagttccaaaaagtggaattattcaaaaacagatttttttcattaaaatccaaaaaaaataattcataaaaaacaaatgcttctatgtatcttaaatttaatctttaaggaagtaatttattagaataatattttatatgacaccaaaataaaatgatacagattgtccgattcatgtgacattataaaagaaatgtctgtccttttatttctgggacgcttcttcagcctcatccatcagtttaatataagtagcatagcgggaatgctgaatttcacctgtttcaagcgcatcaataacggcacatttaggttcgtttacgtgaaggcagttgtgaaatttacactcttctctcttcttgaaaatttcagggaagtaatgctgtacttcttctttttcaatatcgatcatcgcaaattcacgaacgccgggagtatcaatgacatttcctccaaaatcccagaagtgcatttgtgcaaaagttgttgtatgctttcctttcaggtgggtgtccgaaatttcagatgtttttaagttcagcccaggctgtaaagcatttaccagagtagattttccacaccccgaatgtccgaagaatacagaagttttatctttcagaatttcctgaagctgatccagatttaattttgaataggaggaaatttccagtgtattataaccgatttcctggtataggaattcgatgtcttttacgatttcaatttcttcttcgtgtaaaacatcaatcttattgaaaagaatcagtggggtaatattgtaagcttcgcagcatgccagaaacctgtccagaaatcccaatgatgtttcaggatgctttaaggtaaagataaagcatgccagatcaatattggatgcaataatatgagcttcttttgaaaggtttacggattttctgatcagataattagagcgtggctcaattttcgtaatccatgcaatatcatcctgttccagctggaattcaacaaaatctcctacagcaagcggattggtaagtctggtttttatcagtttaaatttccccctgattctggcctcgaaaattttatttgtttccaattccaaaacctggtaccaactgcctgtagatttaatgatttttcctttcatagataatactgctgcaaatatacggaattagggcttagaattcaggaaataggtttaaaaacacatgtttcaattgcctaaatactgatgctaagccctaaattgtattgttgacgaaatcggtaaaagttttatgtacttctctctatcatctataatttatcttttgtcgatcataatgttattctgaacttcaatagactcctcatggattgctttgaatactttttcaataaattcctgagacattcctgtttctttggctttttgtgtagcgtattctgtaattactttccaacgttcgggctggaagatcgcaatatcgttttcctttttaagtttaccgatcttttcagaaattttcatcctttgggaaagaagttcaattaactggaagtcaagatcggaaattaaagttctgtgtctccccatttctccttcaaaacctgcaaggttagagcttctcacctttaaattaccgataagatccgcaagaacctccggtgtgatctgctgagaagcatcgctccatgcctcatcaggattgcagtgtgattcaatgattgctccctggtaccctacgttaagtgcctcctgcgtaatatcagcaagacctgttctgtttccgcagatgtgtgacgggtcaatcagcattggtatattcggaaactggcttttgaaatcaagggcaatctgccagttcgggttgtttctgtattttgttttctggtaggttgaaaatcctctgtggatcactcctaaatttttaatatcctgtcctaatagtctttccaatgctccgatccataaagcaagatccggattaacagggtttttcacgaataccggcttatcagttcctcttaaagccatcgcaatttcctgtactgtaaacggattcactgtagaacgtgccccgatccaaagaacgtccacatctgcctccagagctgcaaatacatggtgtgcattagctacctcagtagctgttttaaaaccatattcttcttttacttttttcagccagttcaaaccgattactcctactccttcaaaaccgttcggtttggtacggggtttccagattcctgcacggaaaaccgacacgttagcattggactctttaattctcctcgcagtttcaagcatctgagcttcactttccgcgctacaaggtcccgcaatcattaaaggctgtgtaagcccatcgatccactcattttttaaatcatttaaattcattattctaaattttattgtttttttatataattttttcgttgacagcaatagccctttggattataaaatttaatttataattcttttcaaaaaatgccgttcaaaattgtttaaaggaatcaggaaaataatagggctctacttctcctgtattttttggaaagaaattcagttaacagtaccaataaaattggtaataggttctgaaatttctataataagaagcagaaaaactaaaataaccgctaaaaaagtaattagcgggtgcaaaaaaagacagatatgtgttagtcagtttttccattttatctggaaatgtctttgttttagcgtttctggttgtaatttgtttttgtcaaaaacttattttcgacagaaatatttgacaaatatataaaaattatgtcaaatcaaacttcattaaatcatcaagatctttcaaaagtggatttttttcgataaacttttcaaacatttttctcttcgtcactacctcaatcttcagattttcaacgtctctgacgtattctatctcgattctatggttctgaacttttcttttaaaatgattaaaaaattccccgcttattttatcaaattctactttggcagaatctgaagggaacaaaactttgattttatgttcttcagctttttccagcttaaaggtttttactgcgttgaacacaaagttatttttaatctgaagctgcttaagcataattttccattctgtctgcagatctgtatctgtaaaatggttttgaggaagattttcagttctcacaactacatcttctgttgcttccactttatcttctttattcagaaaggaattgatgctgaaacctgaagagattccctgttttgacaatggcttggttgttttggctactgaaactgcctgaactgtctgagaagctgcaggctgctgctctgctttaacttctatcttctccggagttctttccggcattttcacttcctgtttctcactgagaaacggagccagtatcaggaacttttttttttagtatcgcctaaattagctgtcagtgaagccagctgcattaatgcaatttcaaccgtaagtcttgggtttttggagtttttataattgatgtccgcatggttgcagatctcaataccatctatcagttgctgggcggtccatttctgtccctgttctacaaatttggctttggtcttctctcctacttcaatgagttccattgttgatgcattctgtgccatcatcaggtcccggaaatgatttcctaatccggcaatgaaaatatggggatcaaaacctttttttacaatttcattgaacgcagaaagcacttccggaattttattttccttggcaagatccacaatattgagatactgatcgtaatccagaatattcagtacttcggctgctttgaccagtgtaatatttctctgggagaaagtagacagcctgtcgaagatggaaagcgcatctcttaaagcaccatcggctttctgagcgatcaggtacaatgcgtcatcttcataacggatattttctttctctgcaatatttctcagatgattctggatgtcttcaatgacaattctcttgaaatcatagatctgacagcgggataaaatggtaggaataatcttatgcttctccgtggttgccaaaatgaaaatagcatgggcaggcggttcttccagcgttttcaggaaagcattgaaagcggcagaagacagcatatgaacctcatctatgatatatactttgtatttaccaacctgaggagcaaaacgtacctggtctatcagttccctgatatcatctacagagttattggatgcagcatccagctcatagatattatacgcaaagccgtcttctgaaaccgagccatctttctcattgatctttcttgccagaatcctggcacaagtagttttacccacaccacgaggaccgcaaaaaagcaatgcctgagctaattggctttcttcaattgcatgttctaaagtatccgtaatatgggattgtcctacaaccgtatcaaactcctgaggacgatattttcttgcagatactataaaattttccattggccaaaagtaagaaatatagttttaatttgaaaattaaaagttttcaaattatcaacaaaaaatatatttctgcttaaatcggaaaacttttaattcctacttttttttgctgtatgcaaagtcgatcagctcaacgatagcgccttcaatttcttttctgccttcttcagttttcaggtcaatcccacagaacttacttgcgttgtatcctgtataaaggttgagataataagcaccggaaacaataagagccataattgccctgtgtcttgttgccacaccttctccgaagtaaggatccgagatatttccaaataggacctctcccacttcttcacgctgatcaaccagttttttaaggataggcttgctttcagaaagttcccaaagaataattttctgaagttccttatttttcttcaggttttcgaactgattaagcacaaccattttggtaagctcatgcccgccgtcagaaaagtccatatcaacatcctggttgacctggctccagtaatcctgcgatttgatatactcatcgatcagtttatcagtacttccgaagtactcatagatcagttttttatcaaatccggcaacggcagcgattttacttacttttaatccggaatatccttttactcttaaaattttaccaactgcagcaagcagtttctgttttgttttttctttgtccctaatggggccctgcactacttttctaggcataattattattttttcgcaatatgcaattttttattaatatcatcaaacgcattaagcgttttgtcgagatgttctttttcatgtcttgcagtaacactcatcctgatacgcgcatcttttcttggtacagccgggtaaagaatcgggttggtatagattcctttttctattagtagttttccggcttctcctgttacataagggtctcctatttttacaggaataatggcagagcaggttactccggtatccaatcccagatcatcaagaccttttttgaaatagttgatattattccagagtttttctctccagataggttcttcatcaattaaatcaatggctttaacgattcctgcggatgatggcggagctgtagctgagaagatctgctgacgggaatggaatctgatgaatgcagctatttttttatctgcaatgacatatcctccaagatttccaaatgttttgctgaatgtaccagtgataaggtctactttatccaataatccagcctgttccaaagtacctctccccgtttctccaaggatgccgacaccatgtacgtcgtccaccatcagaaaggcattgtacttttttaccagattatagatctcattaatacgggaagtatctccatcctgggaatacactccatctactacaacgagtttcgtacggtacagattttcagataccttcaaaatgtgttccaaagattccagattattgtgcggaaatgtttttttattggtaaaagcacatccttcgtgtacgctggcatgtactgccatatctaaaatagcaagatcttctttctgcattaagcattgtaaagtcgcactgttagcggtatacccggtagtgaatactacggcttcgtcttctgttcgtttaaaaaagcctgaaatctttttttctaaagcattatgatagtcaaaatatccaccgataagaggagtggctcctgtacctgtaccatatttttctattccttcaatagcagcctgctttacttttgggtgttgtgtaaatcccaaataatcacttgatacgaaactaacgaattctctgttgcggtctgcaatatttacattcagtactgcattggttcctgaagtattcttcagtctgtagttcatgtgcccgttagactttacatagtctaaatattcataaaaaatttcagccctttgagccatgtcattgtctggtatattctcaaagtctttgatagttgctgttgtgaaattgatgctcatccttaatcttgtttgttgtgtggttttaaaaaaaaacaaatatataattatttagagggcttaagctcccttcctaagattaaatattattaaaagcacaataatttattcttatgttctggaaaccaaactcaattgtatacctctgtttcttttaacatttttctttattgaattaattagttttttcttacctaaatttaataaaaaaagtaaacaataaagaaatattaatagataaataataaaaaaatgcaattattttttacaaccccctcatttataaaagattattttgcggtaattttaacaatataattcactaaattgtatttaaaacatcattacagcatgattaaatccctacctagagacaggaattgccgtaaattacctgctaaagcaattttaaagaaataaaataaatggattaagatttatttgattttctgaattccccaggagtctgtccggtcatttttttgaaaaacttggaaaaattggaagggtcataagtaaaaatgcgggcaatttccgcaacagatttattggaagtaataagcgtatttttggcctgctcaattattttttcatcatagaaagaacaaggatgctgtccggtttcctttttaacagtatcggtaagatgtttgtgagatacagcaagctctccggcaatttcgtttaattccataaattccggaacggtcccggagatgacctcctggatatgcttgtctaaaaaggtaaaatactgacgggtgatctcttcacttcttttcatcattgagggttcttcttaatctgtattcaaattataaaattaatcattagagacaaaacagcacggtgaacttttcggatatttaaagtcaacatttagtaaaaactatctttaaaagcctgtgtagaattcttcaccttcaacttttccagaatattctgacggtggcggcttacggtgttgacacttatagacaacatatctgcaatttccttgctggcatatccttcaccaacaaacttcagaacctccagctctctcgggctcagaatgcttttataatcaagcttatcttttacaaccacttctccttttatcatattcactatcataaaatcaggagcatcagacggagtcagagcaatattataaaggcataatgccagcctcaacctttcgttgtgaggtgaataaatataaaacattcggtgctttacccatctgtacttttcatttttatctttcatcctgatttttgaaagcacgctgtacgctgtacgtttcttcatttccatcgcatcaagtaatttgaaaaaacggagttcgtggatatattttttcagacggtcatccggatgtatctttttcagcatttcttcttcccagatggtttcaatttctgcaggattttcatctgtactaagtccaagttctgttgctgcttcagacttataaatataacttctattctcctgcatatcactcaatacacatattgcaccttccatctgagaataaacaagagctctctgcttatagatttctatatcaagcaggcatttttttgaagtgttatcaagtaatttatcgctaagttgttcacggatttccataatggttatttatcagtattgacgaaaatgtggtttaataatacttttgctaaaataataattacgtttagaacttatttcaaagagaatgaagaaattgattttaggtttttgcaccttattcctgactcaaaagttttccgcccagaccctggagaaaatgacatggtttaatgaacctgaaaaatgggaaatcaaaaacaacagtctttcaatgtttgtaactcctcaaagcgactattggagggtttcacattacggatttactgtagatgatgctcctttttattatacaacttatggcggcgaatttgaggcaaaagtaaaaataaccggaagctataaggccagatttgatcagatgggccttatgctgagaacagataaagagcattatatcaaagctggagttgagtttgtagatggaaaatataacctgagcactgcagtaactcacaataaaagtgactggagtgtcattacactggagaaaacacctcccgcagtatggatcaaagcagtaagaagattagatgctgttgagattttttattcttttgatgacaagaactatatcatgatgcgtaacgctcctcttcaggataatactcctgtaatggtcggattaatggcagcatgtcctgacggacaaggattcaatgcaacttttgaacactttaaagtaaaacatcttccggatcagcgtaggctgcagtggcttgaaacccatcaatagcgattgaattacacttcaatatacagtcaattttattcacctcccatcatttccgggaggtttttatttttataaagacaggtggcaggtgacaacaaaaagaggctgttgatgttattacagcctcttgtgtttttgagataaaaaccgtttgtgttcttagaatcattattgtgacaataaagcttctttagtcattatgagaatattttgcaaaaatatgaatatccatgagccttgacaaagatgtcatgtagaattaacctcagatttttgtcaaattattactacaaataacaattaaaaaaaacttaagtcgttattagtaaatgtgtaaaaaatatacagatttacaatatttgtcatttataaaattctaaaataaatttaaagtacggtacaccactgtgatttactaaaggattttaaaatgaatctgtcataaatttatcacttattattgaaataacataattctttcagaaaattttgagtaccacattaacagcaaaccgctatgcaacttacataaaacaggagataagatgctgatttatctccataatttcactatttttacacgatcaaaaaatataaaacacaaaagaccagaaaacttcaatgataaaaatttattctcaatcgttcctgccctttaaaaagactttgacttgtattaatactattattaaccatctattgcattagcagcagatacagataagtcttgcacatatatgaaaatctgggcatttatttttgcttgcatatatttaaacatttccggacagcgccacacttcttcgtggtacaacatagacaatgggcttccgcaaagcagtgcaaaggccattgtgaaggataaatatggctttatctggatctctacagaaaacggactggtacgctatgacggaacttcgtttattacttttaataatttcagggtaaataacctgcatttcggtgaattcatcggtgatccgctactcgacagtataacggttcttaataattttcaggagaataaaatcatcatcaaaaacaggtttccgaagcttgcaagcctaaccctggatgataaaataacctattccaaaggaggcagcattatacatcgcattgcgaataatatcattacatcggatttttataatgatgtacagtattttatccagcttaagaattctgtctatcattttacagacaaaaatgccattatctataaggaaggaaaaaaagaaataaaaatcatgctccccttttccaaccaggatctgaactatacttttgttttcaatgatactctttttattaatgacctgaaaaaaagaaaaacctattctatctacaaaggtcatctttccatttcttcgcaacctaccctttttaatcatccggatacaaaagtttactggcagcagatcaccaatcagactttcattatcaaccacaataatatttatatcgtagaaggtactgccagtgatcttcgcctgagatttcttgtaaaatatgaggaaatcggaaaccacccatattgtgcgatgttctacgataaggattttaataagttataccttggaacgcttaacaatggattaaatatagttaagctttccaatttttatatttcaaaaaaagaagctgatttttcgaataatgtctattacacctccctccccttcagtaagaatacgatcattagtgaagacggtacagaattcggaagaaatggcattgtaaataaacatcttttcggatacaatgataattatctgatgatgtatgacaattccggaaatattctgatcagaaagagaaacagtatcatcagattttataagaattcaggttataaaaagaaggattctgccctgttcagaaaaggacttcaatcttttatgaagagcggatatttctacgggactgcctttactcatccttcaggaacccagcttcacctttacaggaaagatatatttacacagccggattatacctttaattttaaaagtttcatcaatacattttatcagtacagtaaaaatgaaatcctgaccggaaacagcgacggtttgtattcagtaatgcttggaagcaataccataactcctttactgaaaaacatccatgttaaaagtattatcaggacaaaggataatctgatatggattactacgaataaaagcggattttatcttctcaggaaccacaagcttatcaagatgccgaacgacatcaacaattacctggaatcagcccattatattcttgaagaccaaaagggatattactggatttcttccaataatggtatgttcagggttcctaaaaagcagctgctgcgctacgcagacaacaaaaatactccggttttctattaccgcttcactaaaaaagatggctttctgacgaatgagtttaacggaagttcagaacctaatgcgtatgctcttgaaaacggggactttgtatttccgtcgatggatggttttgtgtttttcaatccggacagtatccggacttattatccggacagaaaaaaaatttatatagaaagggtaaaaatcggaaattccggaccgcagtatttccatcaggtatttgatttaaagaatgattataaaacggcagaggttttcattgacattccttacttttcaaatccgggaaatctttatattgaggccaggctatccggaaaagaagatactgaatgggaaaaagttgcaacaggaacggagctaaaatacaccatcagcaatctctctccgggagattacaccctgagtgtacgggtactggtttctcccgaagggcagtacgaagtaagaacaatacgtttcaaaatccagcctcttttttatcagacactgcttttcagagtttcagcttccatcattatcctgatcatcattattgttattgttcagttgacgaccaatttcctaaggataaaaaataaggctctgaagcagattgtgcataataaaaactccgagctgaaagaaacatcccttcacctggagctggtaaaaagcaatctgcagaaagaaacggaataccagaaaaagctggtagaaaccataagtcatgatattacaactccgatcaggttcattgccatgctttcgcaaaagcttcatgagtctgatgatgtggagcttcagaagaagtattttgacagtatttataaatcctcagagcagctgtatcagtttaccctgaatttaaaagaatacacggaactttataaggctgaaaatatctttgaggaaaaggaatatcctatcaacagaatcctggaaaccaagaacaggctattctgtgaaattgcaaaagaaaaaggaacaacgataaccaatcttgctgaacaaaaagtgtattccagggtcaatgaaagtattttaacagctattattcacaatataattgataatgctgtgaaaaacacctttgaagggaatataaccatggctattactgaaaaccagcaaaaatccataataaccattactgatacgggaacaggaatgtctgcagaacagattgatatttatatgaacctgttcagaaacccaagactggaaactcccagcttcaaaggaaaaggactgggacttcatatggtgattcacctggtgaaaaagatcaatgctgaaataagcttcagacaaaaccagcctcagggaacgattgtgaaaataacactcaataaaaactaacctctatgaatgaaagaattttaatcgctgatgatcattatgtagtaagagccggaacatctttggttcttgagactgcatatccgggactgaaaatagattttgcagaaaactatgaccaggtgaaaaagaagttggaaaatcaaaagtatgatcttctcattttagatattgacatgccgggaacccggtataaaaaaatggtccctgagcttaaaaacatacagaacgaccttaagatccttatcttttcaggatataacaaagatgtagccattcagtatatcagagaaggtgctgaaggatacctgaataagcaaagcagtgaagaagaaattaaaaatgcagtgaaaacagtgattgaaaaaggctatttctatcccgcagagctgattggcctcattattcaaaacaaaagaaataatcctgtagaaaagctgtcatccagagaatacgaaatcttcaaacttcttgcagatggaaacgggaaccttgaaatcgccaacaaacttaatattcagatgtctactgtaagtacttacaaaaaaagaatttttcaaaagcttgatgttaccaatattgcagagctgattaaggtttatgaaatgatgcattaaaaaagggggcggaacccttatcatattccagcccccgaaaaaacacaagtctcattagtttttaggctaatctctttgattttgtatatttttcaatcattgtatttttagaatcatcagacggtttatcagtacaacctctgcacagaaagaaacagttctcgtgtattatcagaagtattagaatctgtagttgtagcatcactgcttccggttgtagatttattatctacacgaaatgcataatatactctgtaccatctgggttccggttcctgtattgtaatgtcaaatgttacggtttcattatgggtctgagtaagataaacaccatcatcaaactgccggtaagctcctggtgataatttaatatttccattatcagagtcaccggtgtgagtagacatttctgaaacccagattttcacatctgatgttcctacattataaagccttggattaaaagtggtagcagctcctgtacctgctgaactgctgttaaattgagcatcaagtctcaggaaaccacctaaaaccggaagatcagtaagataagtactcgctaatgtattggcgccggaagtgcctgccggaatacttccatgataatagatcaaatctccaatggtaatatcatcatcttgtcctccaaacgcaaatttccaggtagtcccgttgaacatataataaccggctttgtcaacttttgctgtttttacagaaggaactgttacagcctgagttacatataccaaagctccggtctgagccgccagatagacattatctttagctcttaactgatcacctgtcatcctgggagccataactccatcagccgcagtagtcacatctggttttccttctacctgcaatgttacttttggagaatctgtattaataccaacctgggaataggctgcaagtgaaaagcacatcattatgccggaaagagttaattttattttcttcattttagtatatttgtttaaaaattattgatttattaaaaaagaaaaaaacttgcaggttaattgatagatcatcaataaccattaatgagctagctggtgcaaagttatctgcattaaacaatcaattttttgaataatcaatgaaaaaccggaaacggctcaacaaaacacaatacgttgcaaatcaaatatttaaaccagtcattttctgaaaactgactgtaataaatgctattgaatgatttaaaaaattatctccttccacaaatgaccgctacaaaagatatacaaattgaacaatacaaaagacagctggtttattattataatattctgatgtctgttattcttgccatatttggtttgatatttacttttattattccggataaaataatggcctggtatcttttcgggggactttttttacttgattatacttatctgattgttcgtaaaacctattcggtgaatgtaatggtgcattcgtatatcattattgcgacactttataatttttacattatgctggctttctggaacaattctatagcgagttttgtctggcttattcctattccgctggcagcctatgttttttttccaaggaaatatgtattcatttacagtctctttgttttgctgaatattgcggcaggatatcttatatcaaaaaatttcagctttgacttcccacagcacagtcaggatgatgtaagaattacagatacaattctgatggtttccaatgttgctgttatatcacttctgctcttttttaaggataaaataaagcgtgttgaaatttatcatgaaattgaaagcaagattcatactccggaaactcaaaccactccggcagcagaaaaaattccttttgcagatgagctgtttgaaaaaatagaatccgtaatgcaggaaaaacaactgtataaagatgtaaattttaatatttcaaagctttctacagtaatggatattaacagcagctatatatcaaaatcaatacgtgcaaaagggtatcccaatttcaacaattacctgaataggtacaggattgaatgtgtaaaaagacttcttcatgaaaatgatattgaaaaagttaccctgatgtatatttacaccgaggcaggattttccaaccaatctactttcaacagggtattcaaacagatggaaaacattactccatctgaatatatcagcaatttacaggtgcactgatttgtttcaccgataaaaatcattgaaacaataatttttaattccggaaaataatcaggaaatttacaggacttaattttctgtctaatccactgcattgtaattgcaaacactcatgaattcatctgaaaaagctcctcagggtagccggcgcctccgatacataaaactttgtattttcttttcaggactttcggtttttgcacagctttacctctttcagcccatgcttcctatggcagcagaacaatttggcgtatccgtaggtgatacttccctgcttgtctcttcttctacaataggtatggcattgggattattattttttgctttcaaagctgacagctattcgagaaaaagcctgatggtcttttcactggtttcatctgccattcttaccattatttctacctggattcctgctttaagccttctgattggtatcggggtgttgaaaggttttgttgtttccggagtttccgcagtggctttggcctatcttacagaggaggtgaatgctcttgcagtgcctgctgccattagtatgtatctcagcggcaatacgatcggaggaatgagcggaagaatattggccactttatttgccggtgaattcggatggcgtaatgctgtgctgcttatcggaatagaaagccttattctgggtgttatattctggaagctgttcccggagtcaaggtttttcaatcctcagaaaacggattatcacctgaaggtaaaacagatgaaatttttccttaccaacccttatatgcttcgtttgtactgtacagctgcattgttgatgggagtttttgtaagtgtttataattaccttacattcagactggaagcgcaaccattttcattaagtcattttatgattgcttttatctttctgatgtatattttcggagtcttcggaactatgattgtagggcgtctttccagaaggttcccgatgaatgatatccttaaaggttctatcctgtttatgcttacgggagccgcattactattatcagaaaatatttatatccttatcttcgggctcggcctttttactctttcattttttgcggcacatactatggccagccagatgacagctttgtatgccaaacgtggaaaatcttcagcaacttctatttactggcttttctattattttggttcaagcatactggggagcggtaccggttatattcttcatgctttttcctggaatattttcataggtatccttattctgtctgttatcattgcacttcttttaaccactgccaatgtgaatccaagggaaaaaacaaaaagctgataccacacagataccacattttattttttgataaaacgccataattcgcgtattggtgtactattttaacagattattaattttttgtagtaaaaatttaacctaatcttgcgtaaaataaccactggcaatgcaatgccgggcatactatttgatatttatcaaagagcatatcaccaccttaaaaaatcaaaatattatgaacgtagcagatctaaaaatcaagaacttagtcgagtacaaaaatcagatttatacgatcactgagatctttcagaatgtcgaccaggcttattttgttaaaattgaaaatgatattcagagtatttcggtcccggccgcttccatcaagcctatcagaataaccgaagaatggctagaaaagctgggattttcacggactgacagttcggatcagagtatacgatatgaaagaccggaagcatttataaaatatgatatcgacctgagctccagaaaaataatggaagggttgaaaatatacggaaatgccatcaagtgtaaatacatccatgagtttcagaatattttctcaagcttgtttggaaaagaaaccgctttacattatggctatctgaagacggaatcatagttaaatagttcttagttgaagaagaccacaatttacatggtaaattgtggtcttccttttttaatttcgctagctttaacagttcaaccataaaataaacggaattaaaaagtttgagaatttttcactttaaatcagagtccggggattctggtattttttaccctaatttacgcgctacccctcgaaattcatctccttcatactgcaactcatccatcattttcctcagttaatcatttaatgatttgattaatagcaaattaaacaaatattaaagtttctttgtgctctcaaaaaaaggaaacatgagaaaaaaatggataataatggcagccctaacacaggcagctcatactttcgctcagatagaaatcagatcagaatatctgccagagcaaaaatacattaatgacaatcgcgaaaagacagatggaaaaagttctgcttttacaacaacacttacagcaacgatcccgatagatgtaaaacctaccgcttatcatcagccgaggatatgggcaaccactatgaatgcttcctatacgtcattcagtaatagtggaactgctgcagaggtgttgccaaaagaaatagcatcagcagatctgggtgtcctttacatgactccacttcatgaaaaactgatgttaatcagcggcctttctgcaggtgtatattctaccaacagtgatcttaagaaattggcaacagatcagattgttgtgaatatccattcttctctcatctggcaggtgggtcccaaaataaaagtgggagcagctcttattgccaataatgcctttgataaacctatgctgattcccatgccatattttcagtatcacagtgaaaaaaagcaaggtatggaatatcatgctgaactgagctatatgcctaaattttctgtaggataccgctttaatgaagcatttgctttacgcattgtcaatcgtccaaagtttttctttgcattaactgaaattgatggtcagaagaaatattttgaccaccattacgtaagtctgggcatagaacctgagtataaaataaaaaaatggacattaaatggtacatttggagctaactttggacgtaccgaccgatatagagacaggcacccctcccaattcctgaagtggggaaatgctacttttgatccttcattttacatttctgccgggattaaatataactttgcaggaaaataaactaattttccaatttacagaaatgacaattcaatcgcattatcaacttttatcatcaacccaatattgaatatggatcttgctgaaattttcagagaccaggaaacaaaggctaaaaaatatgtgatcattctctattatttcatagtcacctctatttatactgtttaccagatctttttcttcaacaccattatgaaaagcagtattctgtcaaaagtcagcctgtgggataatttcctgctgcaatttgtcctgatataccctattgttctgatgatgaccttactggattatttactcataaggcttatcaatgagctcactcctatgcataccagtatgtacaggcatgcttcttcattatttgtaagtaatatccttctgtgtatccttttgtattttgctttcaactttattgttactgagatattcgatttaggaatcaggcaatcgctttcttataaatcaggtctcattcttaacatcaccgccaatcttcccattctgctggtgcttgatttattgttttatttccaggcagagcgtaaagccattaaagcgtctgaaaaggcaaaacatgacatgctgatgtaccagtataatgcgctgagagctcaggtaaacccacattttcttttcaattctctgaatgtattgtcttctctgatctatgaaaatcaggaacaggccaacaaatataccaaagccctgtcccaggtatacagacaagttctttctgtaggcagaaaaccactgaatacattacagaaagaaatgcatttctttcatcagtatctttttttaatggaaatcagatttgaaaacggttttgatattgaaatagctcccatggaacaatgggggaatcgtaaactggttgccttcagttttcagcttcttcttgaaaatgctttcaaacacaatataagttcagccgaagatcctttgcgaatccttatttctgccgatgagaacggaatatctttcagaaacagaatatctttgcgaaatgatatcaccagaggtgaaggaattggcctgtcttttctgaatactcagtacagccgctatcacaaaaagctggaaatcatgaaagagcaaaatgaatttatagtcaaaataccttttgtagaatgaaaaaatacctgattattgaggatgaacgccttgctttttctgaactgaagagaatgatggataagctccgtccggattatctgctgatgaaaagaacccagagcgttctggaatctgttgaatttcttcaggaacacagtccggactttattctgatggatatcagcctttcggacggaagctgttttgaaatattcaatcatattaaactggatgttcctattatttttacaacggcttatgatgaatatgcaatacaggctttcaaagtaaatagtatagattatcttctgaaacctatttctgaagaagatctggaacaggctgttataaaacttgaagatctgcatttcgacaaagtgcaaaaggaaacaggcatccggatggtggaatctttactgatgaaaaagataaaaaacagatttctggtacattcccgtgatggatatctgtatatagagtccggaaatgttgcttatttctacagtgaagaaaaagtggtcatgcttcatacctttgagaataaaaggtatattgtgaattatactctggatcaactggaagaacagcttggagaagactttttcttcagggtctcccgcaactgtattgctaacattaaatcaattaaaggcataaaaaaagcagccaacagcagattagatattgaatttgaacctccctgtccccatgaagtaattgtaagccgtgtaagagtccagaactttcttcaatggctgaatgatgattaaaataaaggatttttctgctgttcattccgtatttttacagtacacttaatgatccgttatgcaagaagttattgtttatcaaatcgattcttttaccaaagaaaagttcaaaggaaatccggctggagttgtgttaaatgctgagcatatgacgtctgaagaaatgcagctcattgccagggaactaaataattctgaaaccgcatttgttttcaaatctgcgcatcccgcagaagattttgattatcacatccggtattttacgcctactacagaagtgccttcctgcgggcatgccactattgcggccctttatgcaaaagcacaggaagatcatctggattcctgtaccgtcagaatccatacacaaattggcatattaccggtttatattgaaaggaaaaacaatgattatctcattaccatgacccaggggaaatttgagctgagccctgcttttgatcctgcaataactcaaaaaattgtactggcactgggactgacaatggatgaccttgacgaaaaatgtcccatacaaattgcgtcaacaggccattcaaaagtaatgatcggtattaaaagcaatataattttaaatcatctggctcctgatcttactgctttggcaaaacttagtaaggaaattggctgtaacggatattttgtatttactttcgataccaatgaaaaagaaatattaaccaacggaagaatgtttgcacctgccatcgggattgctgaagatccggttacaggaaatgccaacgggccacttggaggctatcttattcaaaataagatcgtagagacttctgatgacatttttgaatttaccggaaaacagggtgaagccatcaacagggttggtaaagtgaaagtaagtgtcaatatcaaagatggtaagcctgactcagtcagtattaccggaaatgcagtatgtgttttcagaacaaccatggatttacattaactttcatattatagtaaaatttgtccccacaggagaatatcagtcgtcattaaggtgaatcaaaaaaaattgaatacaatgaaagaattcttattagtctttcgtgcagactacaagtccatgcctaagacatcaccggaacaaatgcaggccaatacccagaaatggatgaactggattgccggaatcgctgctcagaataaactggcagacagaggcaatcgtctggaaagcacaggaaaaattttaaagtcagacggcctgattgctgatgggccttatgctgagattaaagaatcaattatgggctatactctgatcaatgcagaatctgtagaagaggctacagcgttatgtaaggaatgtcctatcctgctattgggtggaagtgtagaaataagagagatcagcaaactgtagtattattttacaaactcaaaagcgcagaacattgttgcttgatttcattttcattgcgtttttgagttttcgaaacaaaatacaattaccttagatatgcctttttatgactcatggtaaatccgaatgaaataacaccgcatttattcaggaccgagtacagcaaaatcgttgcagtgctttgcaggagctttgatatcagacatattgaaattgcagaagatattgccagcgacacctttctgaaagcttcagaatattgggcactgaacggaattcctgataatccttcagcctggctttacaccgtggcaaagaataaagcaaaggattatttcaaacacctttccgttgttgaaaaaaacaaacaagaagaaataaaggccgttgaaaacaactatcagaaaatcgattttgataccaaaaatatttctgacagtcagctggaaatgatttttgcgacctgcaaccctgtcaattcccaggaaacccagatatgcctggcccttcagattctttgtggctttagtatagaagaaattgccaatgcttttttgtccaaaccggaaaccataaaaaaacgtctgcaacgaggccgggaaacactcaggaaacatcattttacaatagattatttaaatgagaaggatattcatcagcgcctggaaacggtattaactactttatatttattgtttaatgaaggatatttctcaagaagccataatcttttaatccgtaaagacctttgtctggaagcgatgagactcacgttgattctcacagaccatccattcaccaatactccaaaagccaacgccttgctggctctgatgtgttttcaaagctcaaggctcgacgcaagggttaatgataaaggtgaagccattctttttgatgaacaggacgaaacgttatgggataaagctttaatagaaaaaggaaattattgcctgatagaggcttgccagagtaataactcttctgtatcaaaatatcatctcgaggctggtattgcttattggcatacttcatcggctgaagataaatggcagcagattttaaacctctacaatcagcttgttgttattgaatactcgcctgttaccgctttaaaccggacttttgctttttcaaaagtctatggaaatcaaaaagcaatcattgaagcagaaaaacttaacctcatcaccagcgaatattatcatggattaatgggctatttatatagtgaaattaacataggtaaagctattcaccattatggggaagccatccgtctgacaaaatcaaaacctgaaaagcagaccttacagaaacagattgatcttttatcttcaaaataaaaagcctcctgatcaatattcaagaggctttctataattatttaacatctgcagttattgagaataattctctttcacgatgagatgaagattgatcagtgcttgtctgttgatctgaacaacatcacagtttttaattttatacttcttctgcaggagtttttcattacaataaaccgcattaatatctagtaattgattcaattgggaagatgaaaggcctaaacattttcttataactgttgaaacctttacattgaaatcaaaaggatatttcatttgaaatgaaatcatttcatttttcatatttgtcaggtcttcaacagaaagatcatcacggataatttcatattctacactttccggatctgtttccacattatttttccttattgtttccagtgaaaatgcatacgtccaggctgtttccaaattattttctgaaaacttatcaaacagatttttgctgatggattcggtccttattcttgaaaatacattcatgttataggtgttgttacatgttacacatcggtaaatcaaccatatatcaatattctttttctgagcattcagtctgaatttgtcactgcattgaaatctgtcgctgttacaatgattgcatttcttttttagtaagggagtattctttgcttttacctcccatatatgttttgtactcattacttatagttgtgcttaatattctttgtaggatttttcccatattattcacacactgcagtaaacttgagatacatctgattttacccagaacttatttaaggttgtttgctgtatattcgtcattattacagacaaatacagacacagctgcttttacaggcattgcaataaataatgtgatgaaatgaaaacctgttcaggtagaattacccaaacgaaagaacgatcagcctgtggttactgagactgatactaagcgataataagtttaagagttgttctcaaaacaagttgtttacttggttatgataaaagtagttaattttattgaagaacagtgtgtttttacatgtaatttcaggcagggaaatttgcaccatattttagggttaaaaaatgagccatacaacaaacaaaaattgaaccttacaacaaacctgtcttttctttttctgacgaactttggggtattaaaatcatcaaaatgaatcagattaataaaatttacatcaatggcgaatttgttacgccaaaaggaacagaaacttttgatcttataagtccggttaccaatcaaaaaacaggcgaagtagttctcggaaatgaggaagacacccgaatggccatcgcagccgcgaaaaaagcttttaaaacattttcaaaaacaacaaaagaagaacgcattggttttcttaaaaagctgcatgaagcggtaaataaacgggaagacgaacttgtttctgtcatggtcaatgaatacggaggaacattacaattttgcagaatgagcgttcagaatgcaatctctgcctttacaactacgatcaagaccttagaatcttatgatttcgaaagaacagccggacattctaaagtgcgttttgaatccctgggtgtagtaggaatcatcacaccctggaatgccagcaacagctttatctgcaacaaactggcaaccgccattgctgccggatgtaccgccgttataaaacccagtgaaatgagtgctgcccaaacccagctgctgacagaatgcttccatgaagccggtttacctgaaggggtattcaacatcgttaacggattaggaaacgttgttggagcagaaattactcagcatcctgatatcgctaaaatctccttcaccggatctaccttaaccggaaaagcgattgccaaaggcgctgtagacaccatgaaaagagtgactctggaactgggaggaaagtctcccaatattatccttgaagatgcggattttgacaaagctattcctatggcggttttcggagcttatatgaacaacgggcaggcatgtattgcccctacccgattgcttgtccctcagaacaggctggatgaggtaaatgaactggctaaaaaagctgcagaacaggtaaaagttggaaaacctgatgaagaggatacgcttgtaggaccaatggtaagtgtcagacaatttgaacgcgtacaaaattatatccgtctgggacaggaagaaggtgcaactctgctggcaggtggtgaaggtaaaccgcagggtcttgaagacggtaactttgtaaaggcaaccatttttaccaacgtacacaacgatatgcgtattgctcaggaagaaatctttggtcctgtattatctattattccttatgctgatgaagaggaagcaattgctattgccaatgacactaattatggtctggctgcttatatcagctcttctgatcaggagcatgcagaacgtgtagcagcccggattgatgccggaagaatctgtatcaatggattttcacatgatccttatgcacctttcggtggttttaagcaaagcgggataggacgtgaatacggggtattcggattggaagcttatctggaaccaaaggctgttattgtataaaaaaatatattcatcacagtacaatgttccaggagcattctgctgtgatgatgctgaaaagttttgtaagtttgaaaaaaagaactgagcaagaaataacacgttgagccatgagtgaacataatattccttttccaataaactattcctgtcatttttcagaattcagggaaggagaacagttttcccggattcacagtctggggcttgttctttccggagaaatggaactgaatgatgggagcacgaaaacgatattcaaagaaggcgaactttattccgcaagaaaaaaccgtttggtgaagtttgcaaaatatcctccaaaagatggcgaaatcaaaactgtaaccctctattttgatgaagcgctcttacgggatttcagccgcgaatatggatatcaggcggagaaaaaagaaaatgtacccgcctatataaaacccagtcaaaaggcattaacttcatttatgtattcattgcttgcctatgaggaattaccttcatctgaagaactgctgcgtctcaaacaaaaggaagcattacttctgatgctgaattacgaccccggtcttaaagatgttttatttgatttctcagagcctcataaaattgatattgaatcttttatgaataaaaattttcacttcaatgtcaatgtagaacgtttcgcctatttaacaggaagaagtttatctgcttttaaaagagattttcagaaaatattcggtattcctccgagacaatggttacagcaccggagattaaaggaagctcattttctgctgacccaaaaaggaagatcggtttctgatatttatctggatctgggatttgaaaatttatcccatttttcttttgcctttaaaaagcagtttggctatcctccaagttcattacagacaaaatagaataaaaaattgatcaggatattacatttaatccagattttaacccttaaatatcagatcgtgtcatgaaaatcataacacgatctgatttgaatctaattattgtaagttttttaaagtgcgtattctacagaagcctctttagcagctgctaccattgctatcagagctttttcagtttcttcccaatgccttgttttaagtccgcagtccggatttacccaaagctggccggcaggaattacattctgggcttttctcagcagctcaatcatttcttcttttgacggaacccttggtgaatggatatcgtataccccaggacctatttcattaggatatttaaagtctgcaaaagcgttcagaagctccatctgggaacgggaacattctatcgtaatcacatctgcatccatatcagcaatattttcaataatatcattgaactcagaatagcacatatgcgtatggatctgggtagcatcctctactccacctgctgaaatcctgaaggcttccactgcccatttcagatagttctgccagtcggtttttcttaacggaaggccttctcttatcgcaggttcatcaatctgaataattctgattcctgctttttccagatccaccacttcatcacggatcgccaatgcaatctgtttacatgtttccgaacgtggctgatcatcacgaacgaaagaccactgtaaaatcgtaacaggacctgtaagcattccttttacccatttcccagtctgggattgtgcatactgggaccagtaaaccgtcatcggagttgggcgggaaacgtcaccgaagattacaggaggctttacacaacggcttccgtaactctgtacccatccgtttttagtgaatacaaaacctttcagctgttctccgaaatactctaccatatcattacgctcaaattctccgtgaaccagcacatcaatcccgatgtcttcctgccagcggattgttcgctgcgtttcttcttttagtaatgtgtcatattgttcagccgtcagttctccttttttgaattttgctctccagcttctgacttctgcagtctgcggaaacgacccgatagttgttgtcgggaataaaggaagctgcaatactttttgctgctgttctttacggattctgaaggtattgattctttgggcgtcttttttagtaaccgcatttgccctctgcttcacctgatcattatggataagaggagaagttcttctgctctcaattgcttttttattttcttcaaatgcttcaggaatctgtttactttccgtttctgacgccagttctttaagcgttactatttccgctactttctgtttggcaaaagccagccagtttttaatttcaggattaagactggtttcaaaatcaagatcacaaggggaatgcagcagtgagcaggatggtgcaattaaaattctttcagaacctaattgattcactgctttttttatcagagacaaagacttttcataatcatttttccagatatttcttccgtcaaccactcctaatgacagacttaggctttcaggaataacgtccagaatatcatccagctgttcaggatttcttacgagatctatgtgcagcacattcacaggaagtgagacagccaaagatgcattatcttttaatccttcaaaataagtggcaataataaatttcagttttggaaaacgtttccttatttcagcatatacaaaatgatatgtttcttttgccttctctgttaaatccaatgccaaaaaaggttcatcaaactgaatccattttgcgccctgatcctgaagtttggttaaaatctccgagtatacggaaagaagatttccggccagatccagcttatcaaatccttcttctttttcttttcctaacaacagataagaaaccagcccgataatcaccggcttggcattgatcccagcctgctttgctcctgcaaattcattgaaaattttgtctgagcttagtttaaactgctggtttttataaaattcaggaacaatataatggtaattggtatcgaaccatttggtcatttccatcgctgtaatatccagtccttctttctgatatcctcttgccatggcaaaataaagatccaactcagaattattctttttaaggactatttcatggtaacgtgacgggattgcgcctaccacaaggctcatatccagaacctgatcatagtatgagaaatcattacacgggataagatctatccctgcttctttctgaatattccagttttgattgcagatatttctgcctgtattcagaagttcttccggaaggattttacctgaccaatactgctcgcaggcttttttgagttctcttttgctaccaatacgcgggtagcccagaatgtgagtttgcattttttaaacttttatattaaaacttgatgtaaagtctttttaaatgcttcttaatgcttaaacaaatagaaatttcaggaaaaatggtatagcagacactacagcttcccacaagagaaaatgtacttgtctgatatatcatctgtatgacccaaagcttcagaccgcgaaagcattgtcaattcagtaaaggcaggtctcctgacttgtaacagtttccgtcatccttcccgcttttagcagtggatatgcaaggacagaaacctttggtatgttacttacagttgcgcgacagctcgtgatttgcacacgattccctattaatttacgttaagtaaaaccttttctgtttgatgaagtatctctaaagaactatacttttactttcaacaactgtcttctgtaaaagtttttaattttgggtaaaaataataatacagaataaagttttagctaaaacaaaataattaagcaaataaaactttataagttataattaaaagcatattatcctgtatatttgactgtttttataattttaaagaataatattctgtggaacaactcgatgataaggatttacagctgctcaggctgctccagaaaaacgccaaactgaccgtaaaagaacttgccaaggaagtaaacctctccgcttctccggtttttgaacggataaaaaggctggaacaggaaggcttcgttaaaagatatgctgccgttcttgatgctgaaaagctcaaccgtggttttaccgttttctgtcagatcaagctgaaaattcatgacagatcagtcggctatgattttgtaaaagaaattctggaaatagaagaagttgccgaatgctataatatttcgggggattttgattttcttctgaaggtacaggtaagagatatgaagcattatcaggattttgtattcaataaactgggctctgtagattctataggaagtacccacagcacttttgtgatggctgaggtaaaaaacaaccatggattgacaatataaactttattaaagttcacattacaaataaaaatccgtcattatttgacggattttgtaatattttttgtggctcagattaattcactgccggattgataagttctgttgttaaacttaatgattttaacaggcttttactgtcgaactgcaatgtaacataatgtttaccttttttgaaaacaagttttgatcctccggggaattcgcttcctgctcccattttctgcgtctttgcaccgtatttactgaactttgttttacaatcctgcaatgtacttttgttcatgataagaccgaaaggaagtccttctactaccacaggtctgttgtctgaagtaacgaaaaacatttcattaactgtatgatcctttcccgggctggtatacatttcaagccctgtcttcattggccatttcacatatttttcttcattggcatcttcataaaaaactggctttatattcaatgctcttgagattttatcggttgtctgcgggaaaataaattctgaattgctgtctaataaagaatttaaagcttctgttttctgggaaaatgcagttacactaaatgccagaaaaaagatggttacaatgaaggtaaaagttgtcgttttcatagattattaaaaatgattcgatggctaaaggtattaaaattatacaattcagtatatacctgctatgaagaaactcaaatttcctgatgttgctgtaaattaaaaaccgttcctgccggatcagtaatccagtgcatattttcagggagcgattcaatttcatcacaggtttccacaccgtttgaccgtaaatattgtgttgctgcttctacatcaggaaccgtaagctgtaaccaggtttcagagtgggtgtaattgtctacacagtctaaccagatcacattattcccgaattgtacttcatgagtccttgaaacggtaggattactgatcggcttctcctctacttccagttttaaaatatctttataaaaagcaacggttttttcatatttacttttaggaatttttatggcgatattaattcctgcctgaaatttcggattcatcatcaaactattttaaaaaattattcagatagttcagaattgttgcggtctgcatcatcacagtgacatggctttgtcccggaacaattgccagttgagatttcggcatagctcccatatcagcagaaactccgcctcctaataacttataggtttttgaaagctcggttttatccagtccatcgttatcaccagcaatgattaaaacgggtaccggaattttagaaatattatcatcccccagatcaaaaggctttccggctgaggctatcatttgctccaggaattttgtccattttgttttatcgggtgctacagcgttataggcggtatgcaagggactgtttgtaaataaatcaggtttcattccttcaaatgctttattgacttccggcagccagccactgcttttataggttgatgaaataattaccagattatttaatctttccgggctctgtattgccagctggtaagctacttccccaccaaaactatatcctgccacatcagccttatcaattttcaggtagtccattatctttgtaacatcactggccaaaacagcgtgtgataatttacgttccgagaacggcgtgtgtccatgcccctgaagttcaacggcaattacttttctggttttagacagttcaggaatcagctctccccaattcatatcaatggtcataaaagcaccatgcagcagtacaagaggctttccattaccatatacttcataatacaccttgataccgttaacgggcgcataaccgctttccgatggttttactttttgtgcggataccatacatgtagcggacaaaacaattatcatcaacaatgattttaacaagacggagaatttgaatatacttttcataataagagtgaatttgataattaaaggtattcaaaattagcaagtccttatgaaacccaacttgccacaagacaagatttattatgcatgatcattctttatttactcattcaataggtaatttggcactggcaacagatattatattttatttattttcagaagattaaaagcaaattattatatataatattgattgaatgtaaatattttcacaataattctacaacagttgataaaaaattactaatttcgaaaagtactaaatctaaattattatgaaaaatttaaagaaaatcgaaagacaggaattgaaaacaattaaaggaggtattgactgcagaggtggccagttatgcttaattggtggtaaatggcaatgtatgccatacgacggatgcggcggtggaaaccagccttaattagtttaaaacaattacttgactatgaaaaattctaaaaaaatcacaagagaacagttgaaaagtatcaacggaggagctttaagctgctccgaagcatgctgcccgccaccagggatcaaaagatgtccatgggtagtctgtgtagcaccatgtgagatattaagttaaaaaccggattctccagataaggcctgcaatttgtataaattgcaggcttttatttttttacatatttccaatcagccttcagtatttttagtataaaaaacattgaaatattcccgataagccctctgaagatcaagttattttatatacatttatataagtgtttaaatcaagcttcaaagtaggtactgcatatcacatctactctactttgatttgatttacaggttcatttatctgatttatacattttattataggacagattaaccatttttattgaggcttattttatgtacgttataacagaccaattaaaaaatttaggattcagcatcaacacattgaataatgtaatacaaagaaataataataaaagaagttttaatacactggagtacttctgtatttatattatgatagaagacatcacattggagatagaaaacattccgtacttcataaaaggtggccatattgcatttttaggacctcagaaacagattgtatttggtgaaaccaaacgtggtgaagtttatcttatcacattttcttccagtttttatgaaagatctgcaaaagacagtatgtttctcaattcaagactcttttttaattatgattctgatgttttcatagcacctttcgaaaatataaaagaaatgaacattgtatttatgggaagaatgcacagttttcagcataaagacgagagtctttatatttcagcggcccataatgctattgaaagactgattctggatgcatttctccatattcctgcagaaacactgaaaaaagatgtaaaacttgattaccttcattacgtcaaccggtttaaaatccttttgcagcgtgactacaaaaaagccaagaaggtttcctactacgccaatgagctgaatatcaccccaagaaaattaacggagatgactgaatatgttctgggaaaaagtgctaaacatattattattgaaaaactcattaatgaatgtaaaaaatcgcttagcttctctggatacaacatttctgaaaccgcttatgagctgggattcagtgatgaaggaaattttagtaattttattaaaaaacatacaggaaaaaatccctcagaaatgaaataatataaaaataatattgtatttttggataaataacaaataagtgaaaaattcatatatggggataagatgtattttttcagtagtattcttttttgtttccgtaaacatttttgctcaggcagatgatgttcagataaatgtgaggctctaccccacacaaatgcttgctgttggaggtgacagtgaaatggttgatgaaacgaatgaaactgcccagccggaaattaattctgtaaccatttcaagtccgtccggttttcagttaggaattcagcaggatgaaaatgaagagtataatcttatcaaaagtcatcatggggttatagaaaaaaaattcatcataaatcaaaaaatacataaaattataaaacagtttaaagataagtccacttttatgatgttaactttaatctctcaataagccgatctggagcagattctctatgcattagatattatttttttaatttttgatgatttatttttagtaaattcataataatataatattcgtttaacaacattaacaagttttttaatttttaattaactgaaatcatcatatttctttataaaatacaatttattatcaagtttttttccaaaaccaaatttacaaatctttagtactttttcacaaaatgagtacctgtagctctgtctaaatttgcacctgaaaaaaaacaagaattaatacactaataaaaactcctgttattttatgaagaaatatatcgtagcctccacgttactatttggttttgttgcattaaaggctcaacaaaccgtaactttaaatgttagactgaagcctatccaaacccttatcgttaatccatctcaaaatgtagttaacttagactataaaaccaaaaatgactacgcagacggggtatcttccttaaatgctgaccatttaagcatttatagtaccggtggtttccaggttaaagtgaaaagtgcgggttcagctttaaaaagcggtgctaaaaatatcgatgccaatactattctgatcaaagccagtgcaggaactgatggagtagacggagctcagtatgcacaaaacgtacagctttcagctactgaagcaacattggtaacatctgcaaatggtggtgtagataaaaaaatcaacatcgaatacaaaggtgcaggtgcgaatgcttatcttaacaattacatcgcaggtcaggatcctactgtttatacaacagaactaacgtatactattatttcacaataagtatttagatattataaaattatatggataaagtgttacagattgtagcactttatctgtactttaacagcaaattataataatgagccgttcctacatcatctttttattttctttatttctattgtgcaccaagactaaggctcagacgggagtatctgtatctcctccaagactttatttcgaatctgacgcaggaaaaagtaccacccaaaaagtaacggtaacaaatgtaagtgcaaaaaattctcttgacatggctgtcagcctgggagactgggagtacaacggaacaggagaaaacaaaatgtctcctgccaatacactgcctacatcctgtgcaagctgggtgaccataaaaaatgaagacacttattttaccttagacccgggggaaagaaaagatattgatgtaactattactccacctaatgcattaacagatcagctgttagctcatactgctgtcctttatgtcagccagatgaatcctgtgaatgatgtggacaataaaggagccaatataaaagtaagcatccgttcaggaattaaacttttccataaattgacggccaaagccactaaaaaaattgaaatccagaatcttacattagcccagtcaaaaaaagaccttactcttttatttgaaaatcagggtaatatctgggcagatggaaaaatacagacagagcttatcaacacagaaaacggtaataaggtatcacttgaccagattattttctataccatgccgggaaacaagagagaggtaaatattccgcttcctgcaacactttcgaagggaaaatatactgcatcggtaatgattgattatggcgacaacaataacctggagttggcggaactgaattttacctatgaataaaatattatgttttctcttatttctgatctccatgagctgtttttcacaagtttcgtatagctcatgggtaaacagttatctgcagattaattcttataacggcaataccaatcctgatgcatataatcttactctggcaggaaatggcaatatcaatataccctactggagagtttctgtacgattgaagcagcctattacatcaaacaacgggaattacatattaccagctaataaaatttcgtttcaaccggtttcatcgtcaggaaaagcttatcccaacccagttcccactattccgcaaattggcatgccacttaatgtgatcctgaaggaagggcaagaagtatttcttattccgcagtccaatgcggcgttgtttaatcagcctgctcagcccaatggttattacagccttcagatcaaatacagcatcaatctggcaggagggtcatatctgggagcatatcctgcatggatcacttttacagctccgttacagtttacggcttatgatcagtacaataatattctcggtaccgtggttcataattttcagtttcagatcggctcgctttcaggaactcccacagatgttccggagctatctatgaagttcggcgcttctgcaatgaatggtattctggaatttaaaaatatgcaggattatgtcaacggggccagtgttacttactctaatgcacttattgtaaaaagcaatacgaattatcagatcaaagtaaaatcgcttcagagccagttcagtgcttcttccggcagttttcttcctcttgatgctgtaaaacttaatctgataccggtttcaggcaacatgggaactgcaaatacgattttactgagtacagcaccacaacttattgctaacggtggttccacgcaaaattctgacgtttattatgacatgcggtattctaccaaacctaatgatgaaaggttcatcaatgctaaatcagaagattatactacaaccattcaattcgagattacgcctcaataatttataatgcttcacaacaagctgttcaggaaaataatactttttttgttgatcccgttttgtatttgggtttcagctcaggctaatgctgatgcagctatcagcatggaaatccgcaatgaacagaattcagctaatccgaacattatagatgtactgcttgttttgaaaaacaatgaaagcaaccattttaaaggcagggttgaagtaaacacccccactggtttcagaaccatttctgacagcaatcctgaaattgaactgaatgccggccagcaactttttattcccttaaaaatactgaagaatgctacaatagtttcaggtaaagcagatctgatcttcaccattactgatgaaaaaaaacatcaggtggtaaaaaaaagtttgtcatatacagtgacagagaataacaacatgaggataaccgctgaaaatcctgttgtctacatgggaacgtataaagattctctggaaatccgggcaagagtttccaatttgggaaataaaaaacagaatgttaccattgtatttaagattccggaagcgacccagaaaaatctgtttattgaaaaaaagggaacgatcaatgttcagaaagattctgtatttgttttccggtttgttccttcaggcaatctgctcagaagttctcagtttacggtgaatattgccggcttcagagaaccggacaaggaaatcttcgggaatacttccgtattggtacaaaatgtttcttctacgcagcgttatcaggacgctgaatttgatctgttttcaaattacagtaaaaatactattaccgccagttacagacgtattggcaacaatacagatatgtatcagcttattgggtcaggtggttttaatctcccctcaggttatatgtttatccgtggtaacatttataccttgaacaatcaaagtgatcccgtggtgaacaatacttacctgacttatcgcagggaaaaaagtgaatttactttggggaatatcagtaagcttatggaagtttcactattcggaagaggggcagaatatgcatatacttcttctgataaggataaaaaaatagaagttggttttgtagatcagagcttcagccttattgaaagaaattcttttctgaaatacggatatggattttatgccagaggaattaccggggctcagaatgcttcgaaaaatttttctgcaacctatattttcaaaaatgatccttatgaaaaggctaatcatcatgtattaggtacggatattcagtatgctttcaataatttctggaaaatgaattccaaggtatacagcggactaagcttttatgaaaatacccatctcacccagccttctctggctttagaggcacaatattccggaaatatcaataaaatcaatctgaacggaaattatttctacagcagtgattattatcccggaaacagaagaggaatagtgcaaatacagcagaatttttcaaccagcatttttaaaaaccattctttatatgcgaatgtaatgatctctaatttttcgccgaaattttactcctacaattatgatatcagatcatacacgacaagaggagatatcggaatcaactttgcaaaaaggaagaatttcggattttctgcaggtgcacaatatcaagaggaaagctccaatacctataataattttctggatacttcaggaaatcaggaaatccagaagctgaaagcattcagagtcactcaaaatataacctgggcgagcaacaacaaaaagcattcttcattactggcactggaaacgggatccgtacaatacccttcatctgataatgctcagcttcagatgaaagctacaggaaactacagttataaatggttcaatataaacgggatataccaatatggcagctattatctctctgaatttgcttcatcaagaatcttcagtaaagacattatttataaaaagttttcagtctctgcttttatcaacaaaaatctcctgagtgaaaagcttactgtcacttcgggattatcctatactgatgatattttatatggtaaatctccttcaggatttgtcaacctaaaatatgcaaaagaaagatatggagtattccttaactcttcctggtacaattactcttccggcaacttcagcaataacctcttcactgttgaagcaggcgtaactcttaatttgcaacccaacagactggacgccagcaaaaaaggagaaatatcagcctttgtttattatgacaacaaccataacgacatttatgacgaaggtgatcaaagtgctgaaaattacatcattatgatcaataatatttctttcaggacaaatagtgaaggtaaaattatttacaaagcaattccgtatggcaagtatatgctgaaacaggtgattcagcagggatggtattaccaggattctgaatttgaagtgaagaaacacagctatttccttcaggttccgctgcaccagaacggaacaattctgggtaaaatcaattatgaatttgatcctaaaaaagcattggaattcgaatctaaaacggcaggaattattttcaatatttatgatggagaccatttactacagcgcgttgttactgatgacagcggtgaattcggttctttccttcgatccggtaattacactgttcagcttgtggaaagctcgttacctgccaatacatactgtgaaaaaataagtcagaatattaccgttcaggcaggaaaattgatgaatcttgagccgtttaccattaaagtatcggagaaaagggtacatgtcaagaaatttggaaactaaagaaaaagcagggttcacggacactcaaacatgataaaattctttgcatgtggaaccaaaaattgtttaaaaaaaacgctgtaaacatttaatgtttacagcgttttagtttattttggttttttacctggcggagagtgagggattttgtacccatttctcatcgccttatggataagattttcgctgtagcatctctgtgaatggcctcaaataggacatttgcaaaaaagtggtaaaatcctaatttaaatcttacgtagtaaaactaaaaatttctgctgaaatctgcaagtaaaaaagtccaaaacttgaacagatttttttagaattcaagccaagaatttatccttctctttggcctgaaatttctcagttgaattatttctaaaagaaaacgaagaaaaaaattttaaaaaaaagaaaaaagaaagccttttgaaaataagcgtggcattctgtcaaggttttttggaaaaagtttttgcgtagattttatacgtaaaaagtttttctgaaatccggagggcttgaccttgacagaatttaagctggtgggctcggtagcgaattatctttggcttctgtttttatttttagtttatgattgtattatctcattctttcttaataatgagaataaattgcatactatcaattgattattacttctaaatgttttaaaaactctttacatttataaaaatcgtaataagaattctttaatatttcaatttgaaattttagaggtaaaaatttaccatatttcgaaaaatccagaatctcaggagtattctccagaagattttctaaaatgaaatcgaaattaatattggatgattctatgctttttaattttaatataaattcttcttgggaagtttttatctcaaaagaagaatccaagtcgaagtaaatattttgaatacctaaaatgtcaaaaataagtttaagcgttctgtttatttttgagccagtaaaagagtaaaatataagatttttattggttgaaagtaatggtcgttccttgaaaatatctgcaaaatcaaagattgaaaattctttctgtatttccgatataacatcctgacttggttcatcaagaaaatcatattcttttttagaaattagcacttccagcattttttctctgattttgtctgcgatattggctccgttgccctcaaagactggtttcttaccatcttttgcaggaattacttctattttctttgattttaagtcaattgctatgattttccagattcttgcagataagtaaatattttcatcttctctaatctgtagggttagtggaatttctcctactttatttcctttatgagatactttgaataaattttcggtttgaaaaacgctgtaaaactctctgttgttaacaattttctctccctcaattcctaaaatcaattctgaaccaagttgttcaagaagatctttctcaactaaaaattcaatgatttcttcgatttcattttctgatatatttttgaaagcacagttatgatgtaattcactcagcaatttttcttttgacattccagaactgccttttatgatagaaagcatttgatgaagcaaaatatcataaggcttttcattcaaagaaaccggctcaatatacttctcatcatataaaagccaacatgcaactgattgtaatagtgtccaacgattagtagcatacaaaaacaaattacttgctttgtcatctcttcgtccacttcttcctactctctggattaatgaagcaatgctatgtgtagcatcaatctgaacgacttggtccacacttccaatatcaattcctaattccaatgtggaagtacacgcgatactaaagttttcatatgtgttattctttgcaaagaattctacatattcccgcacttccttatctacggaagaatgatgggaaaagtaattttggtgtcctccaactttatcagaaatctttctcaatttcacggcaacttcctcaactcttcccctggcatttggaaaaatcaatgatttgctatttcttgtctggatatataaatcttttaataattcgagaggcagttctgcaccgctgccttcaaaatatctgaagactgcattaataggtttggggtttgtatcccgtatgatttttgtgctctcaacgtctccgaggaaacttttcagttctaaatattggttagaatcactgacggttgcagaaagtgctatcgttttgaatctggttttatttattttttgtaaacgtgataaaatagattgcaattgaacgcctctgtcggaacctaaaaaagagtgaacttcatcaattactacatattctaatgaagcaaacaaatgttttacgttataggatttattaacaaacattgcttccaaagattccggtgtaatcagaacgattccgttcggatttttcagcagtttatctttctgacttttgctcgcctcgccgtgccatttggttacactgatgtccaaatattcacacaattcttcaacacgtcgaaactggtcattaatcaaagcaatcaatggagaaatgtaaagaactttcacaccctcttctctaaaatcggttcttgataaaataggtagaaacgcagcttccgtttttccggaagctgttctggaaattaacacataattattctcagtcgataatattctttgaatggcggcttcctgaatcggacgcaaactttcccagcctttgtctctgatgtatttccttattggttcagaaagtagattgaacgacgtcatagttcttcaatactatccaagatattcaagtcatttggtcgctcatcttcaatttcaatatctccaaacaactgctttttgtcaacatccgggttttgacgaatgatattcagaatattcaagaaatcacgaataacttctctgggtgtcaagaactctgatgcacctggcttattaaacatttcttccataaaagcagaaatctcttcatctgaaatactgatttcagttttgtaattaaaatcaaagattaatttcaattttttcaaaagaacaaatatttcattatgatccaaaggcgtaagtttgatgacaggctgtgcaaagtcacgcatttccaaagtttcaaatttgttggtctgcaatctggattttaatgcctggtaactaaacaaacctcttctttcattttcaagaaattctcttgtcccggcgaaattgatgaataaattagagacctttccctgaaagcaatcattgtaaatcgtaagaattttttcatagtttttctcacgcattacggaggtagaaattttgtaaaggttgatagcttcgtcaagatttatcataaatccgctatatcccatacttacaaacaacttgcagaaatttttgagcatatcataaaaattctggtcattgataatctcccgtacacccaaatcctgccttgcttcggtctttgttttatattctcctttcagccattttaatgcattccttcttaaaaattcatcatttttaatatagccttcgtaatatttcacgatgactgaaccaaagtcaaaactacctacttcagtgatttcgttgatggttttcattatggtgttttgaatcagtccaagatattcttcattacggatatcaaccaatgaaatattgttttcctgtgctgtttttgaaataacctgctctatccatttttccaacaatgtctgcaaagcacctccttccggcttggtctggatagcaatattatccataattgcagaatataataaaacactttttccatcattagcataaagacggttatcaggagtaaagtctgcatttgcaactacaaatttttgctttagtgctactgtattgagcaaatgaagcataaatgacttaccgcttccaaaatctccaatccagaatttcgcaatgctgtgtccgttctttacgtcattcagtgcggtaataaaggcttctatttcctctgttcttcctactgttatatgttgcactccaatttttggaacaactccccctacaagagagttaataatggaagttgcttcttttggtttaatattatcaatcattgtttaatagttttttgtaataatccggaaatatggtcaaatagtcatcttcttcttcaatcaatacatcatccagtgtttcatagcaggattcattaattgaatcaatcaccgagctcatcatttggtttttgcttttcaagacttcttccaattcattctgtggaatgctgaagctgtttttttcaaagatttccaatacctctttctgaagttctgaaaggcgtaaatctaaattaaatcttgatatggcggattctgtattattatcgctggctatttgaatctgaacttctccggtttcattttcttctatagaatcagatgtttttatttcatcctccaattcgtcctgaagatattcattcagaagattgaccgttccggaatgctgtttctgaacttcttgtattgaatttctgtcgatgataattttttttcgttttggctcatatacagaagctattctattcagtgcattttcaagttgcctgtctttaataaaattattcagaatttcttcaaaatcttttaattgttcatcggttttaaaaagacttttctgaatggtcttattcatctgcttgttatcaaactttgatgatttcaaatcggaatctatgtaataaacgtaaagcttaagagaacttggcttatcctgtttcgccataaacttggaagcttcataaaaaatattttctaccgaaggattttttatgttttcatcggctagtctgataatttgattttcaaagtcggctatatccgtataagtttgtgttattgtttcaaatttagatttccaacgggtggtattgctttcgttcaataatttttctgtttcaatatcaggagaaacaatattcttctggtcatcaattaagaacacatctaattttgaaatcactttttcatagtatgatgtaaaaatttcaggtgaactgtaattaaactctgctgtcagtttccttttatttgagtagacctctctgacattgttttcgcttaatttcagaatatgtccataaatttctccttttactgaatcaaaagtatatttatagttttggctgccttttctatatcggtaatattttctcacaatcagatcagacaattcatccatcaggttaacgaatgaattatcactagaaacgtaattgctctgaagaaattccacagctctcaaaaactgtttcagtatttcggttctacagaattcaacgttattaaaaacattagtttgaagccagattctgttcaggatttcttcttgttcagttgaaagattaagctttttcttatattttttgccaagcttccagtaatcataatcatattgctgatttttttctctgaaatattctgcttcgtcatccatattaaattcttcaagcttctctagcagaaatgaaacaccatatgattttgttcgcggaaaagtatttcctagcatttctaattgatattcgatttttatataatccttatgaacttcaaaatcatttaataaatcgaaaagtagaataaaagcatagtttgtatttccattgagagaaagaatattcccctttaaaaattccgctctgaatttgtcataaaaatttcgctgctcctgtgtagcatagttaatttcatcataagaatatacatattgatgcggccaataaggaacagaagaataagatgatgacgaagacgaatactctgacgtaatctttatattacttatcaaagtgctcatcaaattagagacatcaataattgaatcgtccttcattttagattccacagagtttatctgatttttaggttgggatggaatgatctcgtttcttttttcattatacgttttttgaggttgtacttttatgggactagaacttgtattcttaaaagttactttattttcaggtgttttcttttggtttttgcttatcgcaatgataaaaaataaaattaccaggatgataaaaaaagtcatattctcctatgtttatatggcatcaaacacatcaaattcgtgaaccagaacaatggtatgtcctgactttctcaagtccaatgccttttcgacttttctaccatagcaggcatagctccagcaagcattgctggtatcgccaataatcagatagtctgttttttttgaaatagaatttacaggaataccacctttatctttaatggcattctgaagttcagttctggttcctctgctgagaattcctgtgacacagaacgttttattttcaaaaataatttcaggatcaactgcgcatattccagaaatatttatatctgccgttgctttatcaattgatgcttttacgtcactattactaagttcaacgaattgcctgataaatgccatcagtattaatctctcgtcttcatcaattttcttatcagaaaccacagaaagaacaagacttcgtatttcatcataaggataataggagttcaggtgttcattctctgaaagccatttgtgaagtttaagaatttctgtatcattgagttctccatcagataagattccgtgaaaaatcccctgaagttgttgcaaatcagaggtaatcccattatagtagatactgtcgtgttcatatttttggcatagccaataaagatcttcaatagcctcctttggtggaataccgttagataccgtattatcaatcagtgacataaattcccgaaatggatttttattcactaaatagtggtgttctcttgcccataactgcaattccctcatctcataagagtttattttatcatcggaaataattcctaataaaatgcctttgagagaattgattgccttatcagctcttgctttaactgtcacaatttgctgttctgagttttcaaagtttgccatagtttttatattcctttttaatagagattccaatatttggaatctagcaaaattaaattattagttttaatagagtttatggttttccgtaatcatatgtttgaaatctttaaaattaattaaaaatttgattaaatttaatttttgggaaatttaaaaggtggtacatgacttaaacgatgtctgaatggattatacgacggctgataatcaatatagcccgaagaatgcagattcttcgggcatttatgatatgtgtcttttgagcgaattttactgatgtacatcacttcatcgcgaaaaatactgccggatttcgaaaacggctgaaatttcagaactggaacctgcactaaaacaaaaaacgctgtaaacattaaatgtttacagcgttttagtttattttggtttttacctagcggagagtgagggattcgaacccccggacctgttacagtcaacagttttcaagactgccgcaatcgaccactctgccaactctccctaaactccggtagtaccgttgttttcagtggtgcaaatatagaaagttttttataactggcaaaatattttttaaaaaaattggcttttctatgcttttagagtaaacccaaaatttcaaacagttaaaaatatgatcattaagaactcaacagcaggtgtttagttttgatcgggcaacatttacttttaatatcaaatgttttactcgtagtaatattcagtagttacatcgccactaaaagctggatgcatgtcatgtttttgcatattcagttcaaatagtctttcgccatttttatttccaccccgtatttttaaagaataccatccgttttctaatgaaagtgttatactgttttcatcattaatagaagcagtatctttcaaataaccgatgcctacaattttcacctcattattagctgtctgaaatatccagcctttcgattctacctctacctcttcatcgttcaaaatctgttcattattcatggaaagccggaaagcataataatcttcctctactcctatgacaggaatagcaattccggatctggttatttcatctccatgttcattttctacaaaatattttaaaatattagtacctgaaagatgatgatcctgcagatactttgctaaaagctgtggactgaatatcacgaaacctttaagttcagagaatatttttttcatatatggattggatttggattagattttgcctgccacgataagtatgacaggcagcaatatggtctgtcagatgattatcatacgggtatctgtctgctatcagtattactttttattaattaatcatattttcttcattaaaagatataaaatcgttttgggatatattgtcaatactatttatcagcttatcttcggcagatatttcctgatcataaaactgctcaagatattcttctccttcatcatcatccccgtcaggattattagtaaaaaactcttcagatttcaggttattgattacatccaaagtatagtctattgtggattttatcttcgcctcctctccttttgcaattttaatgatattggttgcaaccaggacaatatttacagcaattgcagcctgataactactgtattcatcatcttcgggagccaaaccatcaagggcattaaacctctcaatatctgaaagatccaacccgttacctgtaaaaacacgactgaaaacatagtctgcaaactcagtaagctgctcacttccattcttgaagcgctgcgaataatcataattatcatctttaatttcttcttcaaaaagctgatacaggtctttaattcttatcaatgatgacagattaaatttgattttattttctttactaagctgtaatgatttttctttaactgaattttcgctcatgtctttttaattatattttggttgatattttccttcaggaatatggtatttccctccttcctgtctatttttactaaacttacctgttgtaccttcttcaaatttaacattattattgttcatgtgatgctcacaatcaatacaaatttttgtacttggctcaatttcattaattccttttttagcattcaccaaagcttcttcagcgtgaacattatctgctttactttgtatcacagtgactcccatttctttagcccattcttttatctgccttggcacatatttcttacttgaagaaacgtagtagttccccttcccgtcagttcctaccgctgtaacactaaatcctttggcatcaccaagtgtactgtgtgcatctctcaccagctcctgtaaaaagttaacaggatcattatgcagaccaaaaatatctacccaggtattactgtcgctaacaaaagcatacagggtatcattattacccaataatccgataggatcttttgatatgtacattccggaagaagaatcataatatctccatctgttataataaagtccttcaacttcctgatctgcatactggccaagctgccggaatggaataaaataaagttctcctgtatggtctctgaggtttccatagatatcaaactcagctttccagattaactctcctttatcattatgtgactgtattggccttccaatataatctgaaatgatgccgaagcgttctccatttataatttttgcgcaagggaaaagtgctcctctctcatacacccacgtggtaagattctcggttatttcattttctgattccagttcaccagcttcattgatgtatgttataggaaattcttcagtgttgtaactccactcatgcaaaagaacattagcatcccacacaaaccgggttactttattttttgtaatttttgaaattctgcgtccaagcgcatcatattcaaaagtcacctcttttccatccggacgttttactgtgcccagcaacccgttggcattccaggaataggcccaatctccggattcccattccggattccggatttcttctgaaaggtctgtatgtatattgggtaaatcggttccgtcaaacattttcggatggttcagccaatctgaagctatgggcttgtaataaggatgaaaatcttcttgtttttcattacgttccggcttgatgttattgataggccgtttactttttaaaagcaaatttccttcttcatcataatgatagaaccagtttttatcccgcattagctttccgcctttatcataaatacggtcagttcgtcttacgctttcatatagacaaccggtttcatcaggatttttatactgtacttcaccattggaatattctgctgccaccagacttccgaaagcatcatagtcaaatctggtccttccaccggtaactctgtccaatatatgtaacaggcggcttcctgcactccagttgtaatctttatggaacgtggtattgtttttattaacaataactttctggcttaccggcattccaatatgatcaaattcaaaggtgctttccacacctccggtcatttcgcgggaatgcatttgtccgttacggcttatttccagattcattttccagggcagatctgaattttgactggcagctgctactgttataagctgatcaaaatcattataggaataatcaatttctgcacccaaactgctctttaaactgatcaaattaccatgattatcgtattcatactgaatggagtgctcaccttgctgttcgctggtaaccagtcccagtctatttctctggaagataacgctgctgctttcattatctgcccttatcaatagtcctgaagtgtcatactgataggcttcccaggttccgtccggataatgggtctgtgttattcttcctgccagatcatactcataaaagatattattcccgtgaggcgttcttctttgggtaaccagtccgtctttatctctcataaagaatttcttctggccgtcaaaacctgtttcgccaatgatgtcattgttattatttctttcgaaagaatagatctcgcctttttcattggtaatgctcattaaattttcataagcatcatatccaaagactaatgtttcctcttttttatgggtctgcacattccggcgaacctgacgcttcaggcttcccatcggggtatagctcatgagccattcggcacgcccgtccgtagcatatacaggaagatcataggcatcataacggagttttaacggcaattgtccctgttcggacatttctataacccttcccattttatctctgttccaaagagttctgttcaaaggtttcggactaaaaatcagcagtcttccataggcatcatatttccagtactgctctgctccagcactattggtaagctgaataagctggtttctttcattatatccgtaatgagtaacaatatctctttttatgcttctttcaggaaatctctttccgtcaggatattcataggtgatagtttcttctgtaggatcggtatagcttaacaatttaccatcttcatcataatgccatgtttctgaagctcccgatggggaaaaacgggccgtaacctgtccaaattcattgtactggtaatgatattcttcgccatccggagtatggaagattttaatattacccatttcatcataagtatacccgtgaacacgtccttccggcgttcccatcatcttcagttcgttgtgggtagtgtagtcataccaggtttcacctccttctccatctacttttttataaaccagaaagttttcatcgtaatgatactcctctgttttattattttgttttgggtagataacttctgtgtaaccttcctcatcatgataatgaagctgaccttccatatatccatccgttcctttggtatggattactcttccctttttgtcgtattcccactgatagctcattccgttacgattggttcttcttaccacatggttttctccatcataatgaaacacaatggcctttttatgaatatcccagacatgggtaagattaccccgctcatcataatcataacgaacctgcagatctctctgctttttataacaatagtaaacttctgttacttttttgtactccggatgaataatggtttctatactacagccacttttaacatcttttatacttttaaggacaatattccggtcttcatattcatattccctgatggttccgtcaccatattcaatacggattactttatatatagttccttccgaaatatgatggaaacgttgatacgtatagatatcagttcctttacggattacccagatgctgctgcttggtctgtactgccatatcttctgatctctgaaatacgtcatctccccgcctatttcaggagcaggaatcagcattgctatattttcgtccgggtgcatccatccggcaaacttattatcttcttcagggagaataaacagatcatgattattgaaaacaccgtttccaagcgggccaaaatcataaggccggtcgctgtgccagatatttttccagattaaagatgtactgccctgaattacaaaatcatcccattcgaaaaccatggcaccggttgcaaaattcacaggttcaagtccgaaatgacacaatttcttggataaggcattggcaaatttgaatttattgaacggagcctttttaagaacactgttattaagcttttttaaaccgttagctcccaactttcctattttcttggttaagcttctcattaaaaacatacctgcaagacgcatcagcatttctcccggagtataaacatgcggcacaaaggctcctcccaccaatacaggcccgcccgtattgatctggatatacatgcttgaaaaattattgtagaaagcaaagtaagccagaggatttttctttggtttatcaggcattgcaggcagcatggtcattccgaaagggaatcccatacaggtaagtacctgctgaggctgatttccgctcattttacttccctgtgccaaaacagtctgcgagccataataaacctctccttcgtgtggagcttcctgaggaaaaggaataatataaacaggaatcaaagaagtgatatgtctgaatggaattaaaactcccatcacacttgtagttgtagttgctttgtgtcttccgtgaacatatattgaacctcccatcggaatgctttccggaagagacggcatcaggtttcttgcaaattgcggaatcggaatcgtgatggtaatgtaatccataatatcaaaaacaatcccgataaacggatgtggcagcggtaatggaatcagcataaatgaaggcggcggcggaatgagcgtccagtggatatcaattgccagtacaatatcaaaatgcttacttgtatgctgaatggctgtggagggcattgcaggagtgttaacctttatcagcttcactttgctttccggggctgctttttctgcagttacagcgctgccaccacctccccctccactgcctttcgccggctgcccagagtccccgcccgctatggatttaaccatggagacaggattcagtgaatcgaaattatttttcattccgttcttccatccctgtgtggttttatcccagcttaccgaggtaacatctgcatttaccttccaggagcggtccggattcatatccggttttgctaccttgatcggttttactgtttttttattcagatctgccatgattcttttaatttgagattagcctgctttcggtctttccacactcactttccagtcatcaccaaaatagctcttcatttcgttatccagtaatgtttttttatccgtatcaccttcatatttaagaataagcatagaggccacaaacctcagactgctctgttctcttgctgaagaatccatcagttttgctacatcaagacatttttcaaaatacctgatcattttatcttttgtcagaaccgtatcattcaacgtcccgatgattctgtaacactcaatagccattgcatattctccaattttctgagccgtttctgccgctttttcaaaagcattctgtgccctggattttttggaatttcctaataaatggcttccatagttcatatacatctgaacttccagcggagtatccggctctatttcttcaaatatggtttggtaggtgttttctgctttatccttttttttatctgccgtataagcctgggtaagcataaaataggcagaaatttctccctgtttattcttttgctctttagcaagcttcactgcttttttcagtgcatattccgcttctttgaacctttctttacttaaatggttactcgcgataaggatctgctgctgaaaatctgtatccggactgttctttttacggttggtatgggcagcagtattctgcattaactgatgaatatctacttctaccctaaaactatatgctgaggagatatttgacagagtcctgtaatggtgatgctctgcccagaccagtttaatatctttatttccagacttttcgcagattctgcaccattcttttacccacaaagaaagctcttctgcatcactaatccttaacggagctatataaatgaagatgctggaatccttgatactggggaagtttttctttaattccagtaaagggtaaaaggctttgtatgcatctgttttaaagttttcgtcaggttgtctgagttcccattcgggaatattttcttcacttttctttagcatttcatagaattctgtccattcatccaataaggtctgcccgaaagaattcatcccgttaaattcctgataatggagcaaaaaaacatcgtctccctcttcatcttcagaaagtttcgacttgataaatccgtcaaaaagatcggtttcatgtttttctcccaaacagatcagcatgggtttttcttcattctttgaaacaactttctgccattgcctttttaatttcaccaactccaaatctaccggattcatctgccttaattcagttttacagttccacttacaatatttgtctcgcttccgccaccaatattgatttttcctccgctgctgagattggcttcggtctctcctctcatggaaagtgttttggttccgatatccagcgtatcggatttgataccgattcctgaagtcggatcaccattttcaggacctaccccaactccgatacttgaggttccacctactccgatattaattccctgaacaaatatttcttttcctttgatctggatattcccatctttatccatataaatggaactgcttccacaattcagcgtgatagaaatcttgctgtctatggtgatgtttcctgctccatccagaaaaacggagttctgatctttatctctcacggtaattcctcccccgtcatccaggctcatcgtatgtccgcttttactgctcaggctcttaatattattaccggcacctccgcctccgccaacgcctccatggaacattcctcccatcacaaaaggacggtcaggatgctgatgggcaaaattgacaaccacctgatctccttcttccggaattgccatgaacccacggtttttacttactttttcacttccgccaccatcaggagtcattaccctgatatattctgttgtggcagagccattctgccagtcaaactgtaccttcacccgcccctgatttaaaggatctgtattggaaattaccttcgcaaactgagcatccgcttttggagtgtgaaactccgggcggggaataaatcctgtatctgatgcgatggcctcaaaggttcctgtataatatcctcttgcatctacttcgtgatacatttctgtaatcatcagtttggtaaagtaggttgtttcactgctttcagcttttctcatttcgatatcagcaatacagccgggatatagaaagggcacggttgtaactcctgaaataacaaatacttcagcagctttacttcctgctgttcctttctgggaattttcaacatccatgaaagacactgcttttataggagcaactctcagtgatggagttgtaaaggttttctctgaaatttcatacgcccttttcgctatatctgaagtatggttgatctttgagcttcctgcagttaatttttcatttttactgctgttgtagccataaaatgaaggattcacgtgctgtgctttcatttttattttaatatcacttacgctgcttccataggtaagttttacaggtttttcctgaggaggaagttttccgaaatgcaatacttcaccatcataataaaactgttccccataagcttctgcaattcttgccagatagttatagtgagtttcttcatattgtgagctgtaggaaacattcccatgggctgcatctaccctgaaatcgaaagtgttttgtcccaaaccttctttgattacctggtctgcaatactgttcagactgatttcctgtgatcccccaaaactctgaatatgaggtgctgcatctaaaagaacagttgggctggaacctgtaagaactatatttcccagacttcctttttcctgactgaaacctacttcagtaatcactcccacaaaattcctttccggaccgtcttcaacgtctttatacctgaagatcaccgtaattcttttccccaggaaattctgggcttcctcaagattatgattttctgagtttcctaaagtatcgtgagccagcatcagatcaaattcatgatgtcttacagcactttgttttaattgaaaatgtttgaaatgcttgattacttttccgtcaattacaatttcaagttttaccacacggttaattccggcaacttgatttccgggaatcgtattggcattataaattcctgaagtgggctgtttggaccacactttatcttctaccagagtgggaggattaggttgtttaacctggttcataaacatctgagagccgttttgaaccattcctgtataggcctgggcctgaaccattttttctgttgctttcttaatggttccactcgatttttcctgtaattccttagcagttctgctgactgcctgatctgtcaaggtttctttaatattctttacagcgggaattttatctttagaaacaggcattttgggtgaatgatcgtcctgaaacatagttgtaatattttgattgattggatgtcagatttttttaagcctaaaattgatctgagtaatgagatcagataaactttattatccgattccgcctataagccggagccggatatcgtgatcaaaacagggtattagaaaacggtaaaaaggaaaaacaaaatataaagcctgtttacgccctgttaatatcaggatttctcctgatttactattgtaatatgctggttttaatcattattaatttttgtattggattggtggtattacaaagataaaacggtaatcgttattcaggaaattttctccatataatctgaaattttgtagtagttctacgactttttattaataattctaaaacaaatgattaaaaaaaagaagcaaacaactctgtatcaattaaatatttaacaatttttaataattaaaagcagataatttatcacttaaaatagaaatacagtaaaaacagaggaacttttaacaacaaaaaccagctgtattatgcagctggtttatattttaaattcagtaatatctttcttattgttttctaagctctgctacttttttaagataaacatcgctatgatccagaaattcctgatcagtctgatgtactgtaatatgaggcataacgccttgccctcttttctggtccggaagattctgagcatcctgaatcacatgaacaattgagaagccggtctggattccggtgttggggagttcatacaccagtgggaggtgaccgttatgctcatagtagcctcctacagtttcttttccaatgacaatagcgttggtataggatttaatcagagaagccagatgggaggcagcagaagcaaccctttggtctaccaacagatacagctgccccttaaaggttctgtcattaggcataatggaaggatttttgtcatctgcccaatagtatttcccctgaaaattcttaggataaagctgttttaaataagcattcagcccttgcttatcctgaactccattggaaaggaaaagaggggttatcaccagcttttcttccaagggaacttcgttgaatttagtataggcataatgactgtcacggaaaggcctttgtgtaaggtaagaaaatactttttcatacagagctcctgtgccacccgtatttcccctgagatcaataatcagattctgtatgttttcaagttccagagtatccatcatctgatcaaggaaaacgctgaattttttataggcaggatcttcttttccggtggcaaaatcaaatcctcttaaagaaagcctgtaaataccttcaccttctttagtgaaactatatttttcagacagcagctttttatcaaagccaagtgaatgtctggattcctgaagctttttaaagttttccaatggtattcccggcagggaaatctcctttacaaccccattccatcgataccggatcgcataatttttatggtttccgaattctatataaaatttatccagcattcctctttcaaaacctgtggtttccttataaggcattgaatatccatctgaaaaataatactgagaaagacgcctgatcatctcttttgaaggaattccgttgatagaaaggatttctgcaccaaggggtattgctgtatctttagaatcctgaagcaggcgcccgtcaatattcttcagggtaataggcagatattcagatttctgggtaagatagtatgaggcgtggttaggtaaatctgtataattatgacagctcccttcaaatccggtaagtctggcaatgactttatagaaatcgaaaatatttttgcagtttcctgcttctgtttctgcctgctggtagatgctgtctatttgctttttacttctgtacacatacaatccggaatttgcctgttctctgatagaacggaatgctctcagatcttccacaaactgatcaggcgtgaactgaccattcaaaacaggaacgcttttggactcagtaacagaaacctttacggttttacttttttcaagataagatttggcccagattttcacttcatatttttttcctttttcaggagtaaaatagaaacgttcaacactttttatccccctggaatcatcctgttcttttaattttttcccatccataaacaatgcaactcccagattagcatcagcggattgtactgagatccatgttggttgatgagattgtggtgaatatttcagagtatctcctggtttaagctccgaatgagtttgtgcgtatgcactgtttaacaacagtaaaaggggaataataaaaggtctggccattataattttttgaatgggctaatatacaaattaacctcaaccctttgagtactcttcatttcttccctttaacactacaatttcacactcatttcctgcacttcctctgcagaaaatccatagatctgtggtgtttttacatccagaagattcagatagatgtataattctgccctgtgatggatttcatgttctatcatagcccgaagccatttccatacggaaatttcactattagccggcgtcagacatttacgtgtaagatccccgtctgaaaggctgttgatgatttccaggctctggctgtgcatttcgttgaaaaatttaacggtgttttcatagccgtcggcaagttcttttccacatcccggataggcacttctttttccggcgatggtttctccatacatataacgttcaatggctgcaatatgtcttatctgatcaccaatggtaaattttccgggtttataggtaaaatcaatatgttcgggaggaacaatttctataacacgattggttctttctcttatttttccataataatctatgaatgactgtactgtttttatttccatatcttttgttttatcaggtccttttttctgtaaagtgaatataagaaatctagagatataagattttggtttttaccataaatcatctataagattaaaaaaatccctaataagtgagtctaaaatttggaagcttgccaaataaccaatattttagttaaaaaataaccatgatgaaaacaggaatcttcttgtgtattattctgttgggttttaacagtatcacagcccaatccgcaaaaattgatactgaaaaacttcttgagtattatgaaacacaacgttatgccgatgcagctcagtatcttcagagcatatatcccggagaaacacaggatataaaagccctttcacaaatagcttattgtaatatgatggccggtaaactaccggaagcagagaaaaactatcttaaaattaacagtcttcagccgaacagcctgcctactctattcagcttggccggcattaattccagacggggaaatgttgctaatgccaaagcctatcttcagcagattattcagcttgacagccttaacttcagtgcttacaaacaacttgctgcttatgcagacaaacctgagtccagactcgattatctcaaaaaagccaatgctattaatgctactgatcctgatgtagcttatgacctttctttaacctacagtggcctcaaacaataccagcccgcttatgatgtattgaaaacagccatcgctgccgatgcggaaaatttcactttacagcaggctttattaccggttgcaaaccagctaaccaaatatccggaagtgattgagaccggcgaaaaactgctgaaaaaccatgctgacgtcaatgtaatgaacgatatgggacaggcttatttttatgtaaaagattatcagaaatgcattatgatgtacaggacattggaagatatgggagtgcaaaatgaaggcacattctattatatggccttaagctatcgtgagctgaaagattataataaagctgaaatctatgcacaaaaaacgattgatgaagctatttcaaaacacaccactctctattatgctgcactggcaggtatttatgaagccaaaaaccagtataacgaggcggtaaccgcttataaaagaggattgacattcggtaccagtaatattatttattaccgcttaggtcttctctatgacctcaatctgaagcagcctaaaaatgcagccatgtattatcagctatatcttaaaaacaagcctgaccaggaaaaggaaaaagagcagattgcttatgcccagggaagaattcctcttttaaaatagtaacctaacattttgtgattatagtcacaagtggaaactttgttaatccgttaattttgtattcaacaataaaaacaacatttatggacaatacaacccaaaacacagcagaacagtttatccggtatttaaatgaagaaaattttgacaaagcggaaagctgccttgatcctgattttaaatttataggagtattgggaaaaagagacggagcttcagtctatattaaagatatgaagcagatgaaattcaagtatgaaattcttaagacttttacgtccggagaagatgtatgcttctggtataatatcgacatgggagaaaaaacaatagaatcttcaggatggtatcaaatacaggatggaaagattcatactttaaaggtcctgtttgatccgagacctttacttgacaagtaaaataaattgaaaactttgtccccattcatatcctccgctcgtcataaaaaataaagataatttatgaaagaatttgcattgatcttcagactgaaagatatatctgatttcaaaccttctccggaacagattcgggagcgtatggcctggctgggaagcattgcagcccaaaataaactggtggataaagggaatactttattacctgctcccggtaccgctaaaactgtaaagcctgacaatattgtaacggacggcccttataccgagattaaggagttcatcagcggatatattattgtacgggcagaatctatagatgaagcagtggaaatggcgaaaggaaatcctatctttaaaatcggggggaatattgaagtccgagaagttttgaaggcggataagtaaacaggaagatggaagatggaagattggagatggaagttatggcagtttagatccatcccactttttttctccatactgtatattgaatgtctttgctatcaatttccggaatgtcttcagattccggaattttattgatatctgttccgtccagtggcggcaggtttactgtttcacgcactttgtttacattttccttactttctacagggtaaattgttccatcggcggtcagctgtgtcccatatctttgggatttactttgaaaaacctgaatccggtcatataaataagctttatgtaccggattaatatcactgccattttcttccatcatcacataacaggctttcataaattcaggctcgccgatagcatgctgaataataagccaggcagcatcatttgcttttgttcctacttttgagatggttggatatccaatttcggctatgatttcccgcagccgttctgcattagctttgtgaactttttccatttcaggatgataaccgccggataattcgccggctttcaaaagtttttctctaacagacagatctttgtcagccatttcgatcagttctttttcaaaagggagatggttcatattatgcttattgatgattgatgattgataattgaggaatatactctatataatttgatcaagaataaaacctgctctgttttctactgaagctttgggaacttctatggtcgtaaaaccatattcctgataaatttctttcatacactcaaaagtttccactgcctgttcaaaagtttgctttctttcagggtcattttcataaatctctttccatggcggaagaataaaaatatggttgtgataaaccatttctctggctttagattccatgaatgcaggaataggaatattctcaagtctcatgtaaccaagcgtatccagtattccgcggtcaaagaaaacaggttttgtatagcctattttacttatttccagataggtttttacagattcctcaaacatcagttctgcaaaaagttctttattgagccacggaactccttcgccaccggaatctatctgctgtttgataattttccttccttcttcaggcactgtaatcaattcatggcggcttaattcttccagcaatgtcgttttgccggctccgggccctcccgtcataatataaagtggtgaaatatcctgcttcatagatctgaattatattgtaattaaacccaggttttcaaatgatgtggggtttaattgttatttttaataatacttttatatgtattgatacggtcttcttcattgaacatattacataatatcaggagattgtccgtattgtatttttctgaaacctcctgtaatctctggccaacagatcgaggcgtttctgtaataatcctgtctaaaacagtaaagaactcttcttcatctttagttcccagaatcgtttcctcaacagcttccggggaaagaacagcatccggacttaccagctgccgggattgtaaaaactggtaagccattccataggcattccgtctcgcctcttgaatggtagctgccactgatacagctactgcaacctgtaaagaaggctgtggaaaatattttgtcgtatcaaattctctgagataagcatctgtattttctattccgttctcattgttcataaaagcagcaaatgaatatccgaccccatgctttgcagcttccctggcagaagtcattccagagcccagccacatgatttcggggatatgctgcacatgggtgggctgtgcaataagcccgctatatatactttcttcgtctctgatgaactgaatgatttcttccagctttgtctccatattggataggaccactggtttatgattattcaaagccattacagcatcttttagtcctccgggtgcctttcccagtcctaaaataaagcgttcaggatataaagttgacagcattttggtccattctgcaattttataggcagaataattccgcatcatgatgccggctgtccctatcttgatccggcttgttttactaagaacaattgcggctaaaagttcgggactggagctgccatacgcttctactccatgatgttcagagtacataatactatgaaatccagtttcttcagccattacagcaagattaatactgtttgtcaatgctgttgctgcatgatctcccattataacaggtgactggtctaatatccctaacttcagcttcattgtattgaatctattttatggtgaagttatgaaagctttgtttaactgaaaaatataatcttatcattctttaggcggaaagcggattccttcatccttaatcaggtcgtaaccaagtttcatgataatttcaataaccggaatggctttcttccttactttgtaaggctgtactctactttgatggattctgaattgcctatataacaggctttgtttctgatatgtttgtactgcttgtcaacaaaagaaacagatattgagcttactaaaacagcattttcaatttaatttttcagaaataagaccttacttctgatccttatatttgcgactgtctttaataatcgtaattattacaaagtaaatcaaaagtgcaagcatatgaagccctggtacaacaagcagcaaaaaccaccatacaagccctgctccgccactgctgtcaaatagtaaatgataatataatattgaattgtacaagcagaacaatatcatattgaaagcgccgaatttccaactatgcgtaaaggttaccataataagtaagaaacaaactattgaagctgcatataaaagctgattatcattcattgttcgttaaactatttatcatttattttaaactgctttgtttctaagcagatagcagccattagagaaactttttgtccgttaacacaattcataggtttcaaatctgttgatagttgtaagaatgcacttgcagatacaagaaaaagtaatagttgaaatgtttcatggtttgtttttagtgataacaattatacatagaattatcatattttacaaataacatttgccttgtggagtgtctattgtgtaaaagcatgctaacttaaaaaccatcataataactccaaaaaaagaaacctgaatatgtatttttaaattttatttatatcaattccaaataatttcaatactttccatttattgtcacaaatatttaatactttagctcaataatttgaacgaatgggaataatccttaaaccaattgacattgtagatgacatttcacaagaagaattccgtgaaaaatatctaaagccatgtaagcctgtagtaatcaaaaatatggcaagaaagtggcctgcctatcaaaaatggacgatggattatatgaaggaagtagtaggtgacgttgaagttcccctttatgacagttccaaagcagatcctgcagctcctattaatactccgacgacaaaaatgcctttcagtgagtatgttgatcttattcaaagagagcctacagacctgagaatctttttctttgatcctataaaattcgcgccaaaattgctggatgattatgttccgccaaaaaatcttatgggtggatttttagataaatatccaagtatgttctttggaggtaaaggctctgtgactttccttcattatgatattgatatgccacatattttccatacccatttcaatggcagaaagcatgtccttctgtttgaatacaaatggaaaacccgactttataagcttccttatgctacctatgctctggaagattatgatattgccaatcctgattttgaaaaattccctgcgttggacgggattgaaggaattgagtgcttactggaacatggagatactttatttatgcctaccggctggtggcactggatgaaatatctggacggctctttttctatttccctgcgtgcctgggataaaagctgggcggtaaaagcacattctctctggaatcttgctgttcagcgtaattttgataatttcatgaaaggacggtacaaaaagaggtatatggactggaaagaaaggaaagccgtagaaaaagccaatatcgctttgaaaaaaggacttccaaaataacggattttttttaaacatataacagatggatgattggccagaatcatccatcctttttttattaaccttcaggatgtgattcaaaaattaattaaattgcatactacgttccctaatatccgaatatatgtttgaaaagttgatagatagttttgaaaagctatgcctgcagatcattattgaaatactgctggttccggtaaccattttcaaattgtttcaggatccccgccgctgctatgatctgtctgcacacgagatggaaaaagaagaatccgaacgttttcacgactacctctctcctatcaaactttctgtttatacttctgtaatagtctctgtacttttaatggattacagcggagagcataatatcatttccaggattaagggattaagcatggtagaaaaagcactctttatatttctgatgaataatattactgctgtcctattcagtgttgctttattatggtacaaacaggaaaaagtaaataccgtgaccttccggacattgctgttttctttcatttatacaaccgtctatactactactcccttttttatattaatcagttcggctatgtttctggggcagacattaaatgtggaagcttacttggaccaccttggaaaagtgagtgagtatgggacaagagattatctgttttttcttgtctttctggtttttatcatcattggaattatcggagtgttcaagttgttcaaagcgctccattatattctgaagaataatttcagctatcatccttatgtggtatggtttttcacagtgctgttctttgttattcagctttattacgcaagaggatttatttaaaaaccaacataccagtctgttcatatttgtttacatttgtaaaaatcttacatcatgcctaaacctcgagaaagaatagtaaatactgcaatggttctcttccatacacaaggctataacaacacaggtattaaccagataattgacgaagctgatgtatcaaaagcaagcttttaccaacatttcaggtctaaagatgacctttgcatagagttccttaataaaaggtatgactattgggtttctgagcttgaaaaatttacatcggaagcaaaaacacttcaggaaaagttccagaagtcatttgatttcctgatgtacatgaatgaaaaagaagatttccgtggatgcagttttctgaatattctgtcggaaatccctgccgataaggaagaaattcatagggtaatccgtcatcataaaattaagctgagagaatccttcaatgaagatattcaaaatgaaatcatatcagcccacatctatcttctttttgaaagctcaatactgaccagccagctttacagatcgaatgaactgattgaaaaatctaaaatgattgtgcaggaaatactcaattcatcacgttaaacaaaatttaaatttttggctaaagccggtggattggtttataattgtaaggtaggctaaagcccacctctattgatgttgatatccggatgcataatagttgtttaagaaaaagatcttttatcttttatcttttatcttttatcttttatcttttatcttttatcttttatcttttatcttttatcttttatcttttatcttttatcttttatctttataaattctcctgtattaacaattattaaaaaaaccttaattttctcttcaaccctttttccctactgaggattacttttgttctgattttatctaaagaaggaaaaagtgaaaaaaatttttacaactgttttattttgtgcctctgtttttttctatgcacagaccggttctctttccggaaacatcaatgacgattctaaaatagccctgccgggagccaaaatctctcttagtccgggaaatatatataccacttcggatgagcacggaaactttgttttcctgaatgttcctcccggaacctacactatgaagatcgattatctgggatatggaactcatgagtataatgtaactgtggagcctgagaaaaacacccgccagaatattattttcgataaaaaagaaacatcaattgcagccatagtagtttcaggtgccactctgaaaaaccaggcaagagctttaaacaagcaaaaaaataacgctaatattaccaatgtcatttcttccgatcagatcggacgctttccggatgctaatattggagatgctttaaaacgtgttcccggaattactatacaaaatgatcagggtgaagccagaaatcttattatcagaggacttgctcccaatcttaactcagttaccctgaatggtgacagaattccttctgctgaaggcgataaccggaatgttcagatggacctgattccttctgacatgatctctacaatcgaggttaacaaaaccctgactccggatatggatgccgatgccatcggtggttccgtcaacctgattacaagggcttccccgaacggtcagagaatttcagctacgctcgccggaggatacaacccgattcgtgaaaaaggaaattatacagcaggatttgtttatggaaaccgttttttggataaaaaacttggcacagttttcagtttttcctataacaataacaattttggctcagataatattgaacctgtgtggagccaggccaatgattttgcccaaacggtttatgtaagcaaaatgggagttcgttattataatgaacaccgtatcaggcatagttttgatcttaatatggattatgaattcaattccaaaaacaagatctatgcttctgcaatgtacaacttcagaaatgataaagaaacccgatttgctttaggatataaaataaaaccggtatacaacgctgatgaaactgaaattacagattggaaaggaagcattacaagacagaataaaggaggtgatgccgataatgacaatacccgtcttgaaaaacagaaagttcagaactatgctttaagaggtgaacatttactaggttctaaagtagatcttgactggtccgtaaactatgctatcgccagtgaagataagcctcatcagcgttatatagaatttgaaaacagcaaaatgaatttttctccggacctcagtaatcctgagaaacccatgatcaatcttctcgcagcagacaatccgggaagctataaactgagcgatctttccgatgccaacagttttacacaggaaaaggaactgggggcaaaggtgaatgtgcgttttccgttttccgtgattgatggtcagaaaggacgtctccgtaccggtttccgcatgcgtctgaagaaaaaggaaagagaaaatgacttctatgcttttacgcctgtcaacaatatgggaagtcttttatccgttcctacaataaatctggatggtcagaacttccagccggggaattatgttccgggaacattcgttgatccttcttaccttggaaatctggatttattcaatcctgcgttgttcaatggcaagctgaaacctgaaaaatatttatccagcaactacaatgcaaaggagcagatttatgcaggttatatccgttgggaccaggattttaatgagcaactatcgatgatcgttggagcccgtgtagaaaccacacagattgattacaccggaaactatgtcatgaatgaaaaggatctgatagggcaaatcaataataccaatacctacacaaacgtacttccgaatatttcctttaaatatgttccggtgcaggatcttgtgcttcgggctgcatttacgacggcacttgcccgcccgaactactattcactggttccttatctgaatgtaatttcagaagatgaaatcgttgccgccggaaatccgaatctgaaagcaacgtatgcttacaattttgatttcatggcagaaaaatattttaaatctgtcgggattctttccggaggcgttttctacaaaaatctgaatgattttatttatacctattcgaaaaggaattataccgccaatgattttgcgaatgattttgcaggacaaaccaacccgattccggccggagaaagcaactggaagtttacccagcagcgtaacggtgacaatgtagatatttatggttttgaggtcgctttacaaagacagcttgactttattccgggagctttctggaaaggacttggagtgtacgtcaactatacttataccaaatcgaaggcaaaaggaattaccaatgaagaaggcgttgaaaggacagatgtaggatttccgggagctgcccctcatatgttcaacggatctttatcgtgggaaaacaaacgtttctcagccagagtttccatgaattatgcttctcattatattgatgagctgggtggcaaggcatttgatgaccgttattatgacaaacagtttttccttgatgccaatgcttcctacaagattacaagccagctcagagtttttgcagaggccaataatctgacgaatcaaccgttaagatactatcagggaatcccgagcagaaccgctcaggctgaatattacagaccgaggtttacgatgggagtgaaatttgatttttaaaacaaacatgaaaaacatacattatatactggcactttcagttcttccttttgtgatcaactgcagcgggcagcaccaattaacagaaaaattaaaaccaactgttatcacagaaacagttgttcatgataccgatgatcctgcgatatggatcaatcctcaggatgcttcaaaaagtatcatcatcggaacagataaagatacggatggtggcttgtatgcatttgaccttaacggaaaaatcatcaataaagttttaggattaaaacgtcccaacaatgttgatcttgaatatggttttattttaaatggaaaaaaaaccgatattgcagcagtcactgaaagagaaaccaatacagtaaaattatattctcttcccgaactgaaagaagtgggagaaatctctgtatttgaaggagaaacagcacgtggcccgatgggaatttcaatgtataaaaatccacagacagaagaaatatttatcattgtgggaaggaaatcaggtccggctgacggctatctatggcaatataagctttctgaaaaaaacggttccatcaccggagaagtggtacggaaatttgggaaatacagcggtatgaaagagattgaaagcattgctgtagatgacgaaatgggttatatctattattctgatgagcagtttggggttcacaaatattatgctgatccggaaaaaggaaatgaagaattatccgttttcggaaaaggcgattttacatctgatgtggaaggaatttcgatctatcctacttccaaagggaaaggatatattctggtttccaatcagcagaatgatactttcaatgtctatttaagggaagatcaatctaagggaagaattgcagaaatccctgtttctacactggaaagtgacggttctgaagtgaccaatgttaacttaggtccgaaatttccaaaaggcgtttttgttgcgatgagcaatggcagagtatttcattattatgactggagaatggttgaaaaagcaatacaatctgcggtaaaggctaaaaaataaaagaattttgaaccattaaggctgatataaggttttaagagtattaagttgagttacaagtatgagattgcttcacctttggttcgcaatgacaggttgcccatcttaatactcttcattttttcattattcttaatggtttataatcttaatagtttttcaacgcaaagttgattctaagggtagcaatattttaggaagcaaagaaagagttgatttgcaatcaaccgatgaagctggtgtttatctataagctttttaagcagcttgctgcagctctttgctaccttaaaagtaaaaaattatctcttagactttgcgttaaaatttaattctattcttataaggtaaagcttattctaatactcattatttttaattcttttcactgaatatgtttcctcaaaaaatctgcggtgaatgatgttttatttttcaaaagatccgtaggagttccttcaaacaatacttctcctccaaatttccctgcgccgggccccatatcaataatccagtctgcctgtgaaataatatcaagattgtgttcgataacaatcagcgtattactatgatttacaagaccgttaaaaaatgtaagcagtttttgggtatcgcttggatgcagccctgtgcttggttcatccagaataataatctgattggtatttttcagttctcttgtcagtttcaggcgttgtctttcgcctccggaaaagctgtccagcctttgtcctaatgtcagataatcaagtcccaactttatcagaagatcaaaatttttaagaacaaattcttctttaaaaaaatcaacggcctcagaaaccgtcatgttcataacttctgcaattgtttttccatggtatgtatacttcagcacgtcgggatcaaatcctgaacctccacaaacctcacaaggctgttcaatatcatccataaaagcaaggtcaattttttctattcccaatcctttacagtttttacaggctccttcactgtttctgctgaacagcttgtctgaaacctgattagattgtgcaaaaagcttacgtacagtatccgatattccgagataagtaagcaaattggagcgggcacttgcagcgaacaacgactgatcaataatggtcacatccggataaagctcaggtaaaatacgattaataagagtacttttaccggatcctgccactccggttacgactgtcattattccggtcgggatttttacagtcacgtttttaagattatacctgttggcatttttaatttccagataaccatcaggttttctgaattcttgtttgatggaaggtttctttgcgaaataagaacctgttttacctgccgatttttttaaatttttaaatgttccgtcatacaccacctcccctccatttcttcctgaaccgggaccaatatcaataacccggtcagccattttaatcaggtcaggatcatgctctacaattaaaacagaatttcccttatctctgatctgctgtatgatagtgatgatattctgcagatctttcggatgaagtccgatactgggttcatcaaaaatatataagaggtctaccaggctgtttcccagactccgaaccatttttatacgctgagactctcctccggaaagggtattggtacttcggtccaaagtcagatactgcagcccgatcgtaatgatattctgcagttttgctgaaagctctttaataacgacttcatatgcccctgcatccagagaggtaataaattccagcagctcgtctacggaaagcgccatacagtctgcgatattcattccctgaattttacaggataatattttttcattcagacgttttccgttgcatgaagggcaggttttggtgatcacaatatttttcagggcatcttttcttgtgatgttttctttagaatcttttttcaggaatgctttttcaattcttggaacaataccttcgtattttactgtttttccccattccttatgaggatgtttaggtttgtgctccggtgcgtacaacaagatttcccattctttatcggtgaaatctttcagctttttatcattatcgaaatagcctgataaagtatatcttgttaaacgccatccgcctggctgaaaagtcggaaaccttacggctccttcatgcagagatttttcacgatcaattaaggcattcacattcaatgtctgaacaaatcccaatccttcacattccaggcacattccctgtggatgattgaatgaaaaaacattggaatatcctacgaacggctctcccattctggaaaacaaaagtcgtaaagaagcagacacgtccgctgccgttcccaccgtagatctggcattgccgcccaaccgtttttgattgataatgattggaacattcagattttcaattttatctacatccggaaggccataatgctgcaaacggtttctgataaagctgttctgtgtttcattgatctgcctttgtgcctcggctcctatggtttcaaaaaccaatgatgattttccggagcccgatacccccgtaaagaccacgatcctgtattttgggatttttatggaaatatttttgagattattctgacgggcattcgtaatttctatattttccatgataaaaatacttaactttgttaatatttaactaagttaagcatatttgtaatgaaacccattgaaaaagaattttttaacacatttactgatttccagtgccttattctggcacacatgaaccggggtgatattaacggtgtaacggctgctcattataatattattgaatttattttaagaaaaggaaccgctacgggaagagaaatatcaacagcgtttaacatcagtcaggcagccatttcaaagcagctgaaatttctgatcagtcatgattttattatcagaaaacaggaagaaagagatcacagaaagtttaatctttcggtgaccgataagggaaggtttatcatagaaaattctgagacattccgtaagaatattacacggcaggcagcttctatacttacttctaaagaactggaaaatttcaattatctactgggtaaagttttaagtgatataaaattgtaatactcaattcttatttataggtaccaaatactctgtcccagatagaagtatagaatccgaaatttttactttcatccaaatgatgctgattgtgaaacctggttgttcccacaaaaaagcgatcaaaggaagctggaaaaaactccctgttcagatgtcctatggttccccagatcagattaagcaaaagataaatggaaatggaaactacagaaaaatcatatcctataagtaaagccagcatcatgagcccgaatcctatcgtttcaaaaggatgaagaacaaagagactcaaaaaatttgtactgacatgctcatgatgttttccgtgcagcattttatacaggtaaggtaaatgcgcggtaaaatggaagaaatacatcagcaggtccatcaaaagaagcaaagaaacaacttccattgctattcccatgaaggattctgtatgtccaagcactatccatccgtttttccataaaaaagctccgagtaacataacaaaactgttacataatatggtaagcagacttaagtaaaaatcagatctcttgacaggatgatttttctcctgcaacagacttttacggcatgttttttcaataaaaataaatagacttatggaaaacaggtagagaaaaatattgacaatcaggctgaatatgatccattccggccaggaaaactgccagaatatatttaaataaccggaaagctcagcttgattaaaattcataaatccttcatccttcaacttgatatcataaaggtatgaatttcaccgcaaagtcagctataaagtctgtatctgtgctatttctgtcttgcctttcttctgagttcccgaagtcttgaggttagcttttttcttaaatcattatgatatgcgcggtaatttttgatgctgttttccaggttcttcttattaagcagatactcttcatacagatggctcagttctgaaatctgggtaatcacctctgaaggctggctttcaggatcttccgcagcttctatcagcagacgataatattcaatacggctggtcaggttcatgtgaagttttggttctattccctgcatggttttatgattttatggtgtttctgaatagattgaagcaacaggctaaaagactaaatggcaaaatggcaaagagacttttatagattgtactttaattattctatattttatttttatttgtcattattaaaaatccgcaatcagctattttgcctttcactattttactctttcgctttttcgcttttcgatataagttacttccccgctacgataggcggcacatcactctgaaataaaattctgatatttccattcttttctttatctgctgatttgaaatatcctccgttcaaagcagaagcgataagggtttcatcaggatctcccagaggtaacaacggaagtcctgcatattcattaacgattacctgtggtgaaattccattgctgtattctccggagccactggcattaaatactttgtagattactgggtgaatctgccaggaaatttttctgggtttacgtttatcttccactacaaatcctgccatatctttccccaaagtggtgtttccaatctgaatgacctgcatatacggcttcagattattgatgacaatttcagcggcagatgctgtactgttggaagtaaggatgaaaactttctgtaaacctaacgcattggcccgtagagttgtgaaatctaaagctttggaatcataggcaatttgctctgcaaatgttctttttacttcaccaccatttttatttcctttaaaaataatgaatggtgaaacggatgaaagaccggcaggaatcagggaacaaagtgcagccgcagaagatacggaacctccataattgtaacggagatcaagaatcagctcctgcacaccggcagctttaaattctgcaaatttttgattcagagcctgggtcatcccgtccggaaaatcatagatatacaggtaacccacttttttactgtttttatcaaaaatcttagataagatgggttgttcaaaagagaagccgtaataaacggtaatatttttttcattgatgacagctccattctgccattttccaacggtaagttctacaacggtctgatctttaatggatgcagccatagcttcagcattggcggccgtcattactttcccgttgactttggtaataatcataccccgttccagccctgcattgaaagccggagagttttgaaggaccagcttaaccacagtaactacttcattattggccagctgaactacggtataatcaaaaccgtacatattccttatagaacgtggataggtagaggaatcttcagtattcaccatgaaagaaaaccggtcttggggagatagcaggcttttaaaaaaatctttggcaggaagtctgtaatccggttttgcaggcatctgctctgcccagtaatagtatcgtttcatactgtcctgaacccagagattcacagcttctgtgcttccttccggaaaaacaggtgcgctttcgtcattattatttgtacatgaaatgagaaaggctgcgatcgcaaagcatagaagttttaaaaagtttttcatacgtattacagatattctgccacatcaatatctcctttcactacccattccccattttccattttttcctgaaggacgatcatattggctcctgtgtgctgttttaatttcacctgaatcattttagatcctgcatagggttctgtagttcccggcttgtataattcaagataaaccggagcggttgagctgaaaaaactatagactttcactgcagtaaaattatctttactgatattatcaaattcagccagcactactccgttttctcttttcagaataccttttacatttttcagagaagttccggaaagttcgcccaggtttggaaaaataaattcaaatcctacttttccgagattcacctggggttttacagcataagtttgcaggtaaatccccggaagattaaaaaagtaaagatctttatagttctctatattgtcataagtaatattgtattttgcaatttcagcgcctgtttcattgttataaacagacagtttattggtttctccctgatccagtacaaactgaagccgggtttctattttattggtataagacgtttttccgtcaatggttacaggctgaccgttaaacctcagctgtagctcatcaggttttgaaaatcctttgatattaacttctccgggtttctgtactttatcatataactccatcgtattgttgtctgtgcatgaaaacagtacagtgaataacagtagtaatgcgaagattttattcatctttcttcaattatttcttgtaactttaaaaatattgcccggcccgtgagccgggcaatacacaattataaaaaaactagttggatatgttccggatagcttttttcaaagactctccgttatttatatttaaaatttcatggtgattctcccatcagattctaaaggatcagaataatgattatttcttaataaatttcagtctttccgtagtctttccatcagtaatttccgcgatatacgctcctggtgtaagaccagccagatgaatcgttttggaatactgagcggttaatactttttgtcctgctgcattgtagatactgactacggttatattttctttcaatgccggattaagctgcagctgcaaagattcttttaccggattttctgcaatttgtgttacaattttgtttctttttacatccttagttcccaaaaatgaatcggcataaattcctatttcatcaatattaatgttctggatattatttccgcttgcttttctgttggcccacatcccgatatagattttctttcctgcaaaagcagaaagatctacaagggattctacaaactccgtgagatccaccggaaatggattggcagaatctcctacctgtattttataggcacttgaaatatcattgccattggcgtctaccgtcattgcctgaaaatcagataatgcaggaacttctttctgtggtgtgcttacatagataaaaagatctctggcaacaatggtatgagtagatctctgtcttcctatataagctgctaaagtgacagttcctgaaacatttgtaagatcaatctggggagaaataatccagtcattttctgttccaaatcctgtagcatttccggttggaaccaaactgatcgaatggcgaagaacacctgctgttccataggttagcgatgttccgttgtgatagatgttttgtccctgtacccatccgttgccattgctgttcagatcatggaaggtccatccctgaagatcagcaggagtgtcaaaagagtttccccataccagagactgtgctgcagccaggtgggataaaaacagaacagatgataaaattatttttttcataatgctgatgattaagattttgaataaagcaaggaatcagcatgtgctgttccctgcttttttaaagatttttattattctacaatcgtgaaattgtattttgtccagattccctggaagtttccacagtttcttggagatacattccagcttccttcgttgtagaacggctggctcataccccatagagatgcaggagtgccagtggcaaggttagctgcagggattcctgctgtacctgtacccgtaactgaagtagtaaatccgtgaatctggatggtattgtatgctgaagctgaagaaagttcagaacctgtaccttctactttgattccaacaggatatcctgtaactacggcattgtttaatgttaatcttccgtgtcttctgatgtgaataccgttttcatacaaagcacctttagcagagttcttaggacctacgatagtaaggttgttgattaccgggtgagtcaataatgatgtagaagaaccatctgcattgttatcaagctcaataccgttagaatccgggctagctccgctaagactgtgtgtagagttataatctgccaaagctaatgcacaagtaatcgttcctgtatatccgttatcgaaatcgaaattatcatcatccgcagcaaaagaaacaaggtttgaagcgtttacagtaccaccaaagaattcaaaagagtcatctttcccgaaagatacctggatatgatccagagtcgttccgcttcctactcctcctaaagtaagaccgttgatttcatttcctgagttcggagctaaaagatcgtatcctgcaaactcaatacgtacatatttcaatgttccaccgttatgagaagaattggtaccaccgtaatagaaatcaggaccggataatccttcgattgtttttgtgaaaggcgtgtttgtaggagcatctcctaatataataacccctccgaaatcaccaggagcagcagtagtatcttcgtttccatccagcaatttgtagctggtgaagatgattggctgagcttctgtacctgttgcattgatttttcctgttttagcaattaccaacactcctgtagctgtattgttagtgtttggcttagctttaatgaatgtacccggctggattgttaatgtagcaccattttttacggttacaactccatctaattcaactacaccgctccatgtagtatttgtagtaatagcaccacttacgctggttaccggaagagccgaagctgtaaggtactcagcagaagtagatttcatttcgaatggagatgatgaatccgccagttgatcgttttgacaagctgtaagagataatgctgccactgcaattagagttagtcttttcattgttataatttttaataaatccggtcgtgttattttttataccagatcagttttttattcaggaataccttcctcttattccttcgatttgttttttggtgttcctcccatcgctgcaggaggagctgcattgcgggagttcccttgagaatcgttaaagcccgggaaaacttataacaccggctttgtcagaactgtactgttgtgcgcatcaacagtttaatcagttttgatcaggctgccggaacctgtacgctgctataattaagatatctttctgtatctgttgatatacttttaaaaagtataattcacactcaggctgaacattcttccgctgtaggcccgaaacataattttatcaatatttttatcgtacctgtctgtagctcccggaagaagatcccatgcttccctgtctgtaccgacattactgccgcctccgtttttttcagcgagataagaattgaagttgttgtaatattccttaaccctgttaaaaatgtttctcacattaaattttacttcaaagtttctgtcgcggagaaatttataggagatctgggcatctgccactgcataaggacgctggatttcctctcctttgtaagcataccctacggtgatatactgatctcctttagcattgtataaaaaactcagtcccaaacgatcaccatcatacgtcaatccaagattataggcataaggagtctgtccgtaaagcggtcttttcacttcgtaagtttcatcattgtctcccgttttatacagatctttaaaagccactactttcgtatcgttataggtgaagtttccgcttatgaaaagcttttccagaaaggttccatctgcaataaatcctaaattctttcttacctcagcttccactcccaataattttgcatttttcgaattaccattatagagatacaaatttccttcgctggaaatatgtccttcacgttctatgggtctgtctatatttttataatacaaccctgcagaaaatatttctcccaacccgggaaaccattcaaatttgaaatcataattattaatgacagaggatgtcatttcggtattatagatcaaaccattggcaatcgggtcaaaatatggcaaaccggttctttcattaaactgtggacggatgacagatttattataggcaagtctcagattgatcttgttggtagggctatatgtaaaattcgcagaaggcatccattgccatggtttatcatcaatggccgctctttctacattctttgtatcacttggatctaattgctgtgaaataagatcatatttaaagtattctgcacgaagtccccaaactaaccttaattttttccaacggttatcaaacatcacaaagaccgcatgctgactaacctctccttcatacttgtcatttttatacaatgccttggtttcccagccaataccacccggaacataatgggagccattaaaccattcagcaagcgaaccatacatcgtcaaatagttcttttcgctgttcggaacgtcccggttttcgtcaacacgaagaaaaaacttctgctgttggttggtattgttttttatagcaccggcatatcctgttttaatggtatttttaaagcttcctgcatccatatcccacttaacggacgcaccgtaattgtaatctgtttctttgttttctatatatcctctgtaaaaatcggctccggaattatagatcttatgaaatgtgagaatttcatttccgataaagtcgtacctggtaatatactgtgtgtaatctttggtatcagatgccactcctgtacgggctgcaaaccaactgatctctgtatttcccattttatggcttccttccagtttattttgtaaaagggtttgaaaaatcgggtaattggtattatccgtataaggcctgtccaggtttttgatctgttccggatcattattggggataacaccgttataaaaataattataagctaattctgcattggcagccattccacttccggttgaatattcattccatccggttactcttgtcagtgtattatcaaaaatatgggtataggaattacggaacgagattctgtttttcccaagttgcaatccaaaattaagcatccctgccagtgtagaattgtaattataggaagctccgctgtttttgaaattatagaatggaatctgtccgtttgcatctggcattcccgtggtatccaaccagtttcctcttcctgtatggtctatgtccagtttattctgttcatttctgatgacgaatgctccggcaaaaccccatttattattgtttttaagcgcgtaggtcctccctaatgccagctggatattagatcccatatcacctttggttgtataagtgctgaaattgtcattcgtaaactgtctggactgctcaaaaaatcttgaatctgtccagttcatcggctcaagtcccttggggaagtcccttgtcccgtcatcatacccgaaataatcgtactttcctcgtttacgggtcagaaattctttgaaggcagactggtcattatacgaagttcccatggttactgttgtaaaattttcgttgggaatatctttggtccttacttccacataccctcctgcgaagctggcattcatatcaggtgttgcagatttgcttaccactacaccttctaccatggcagtaggaatgatatcgaatgaaaaattctggttataggcttccgtacttggaagattgatcccatccatggctgcagtattccaacgttctcccatagaccgtaccactacatatttattatcaatggtggtaattcctgttacccttttcagagttcctcccacatcgctgtccggagttttggaaatctgttctgctgagataccgtcgctcatctgggccgctttcttctgctgtgcaagaagcccggcctgggtatctgccttgcgggctgcagtaatcacaacttccttgatgtctgttattttatcggatgctttgtttaaagcaaatgacacagaattggtttcattattgataacagataatttctgaactctcagcgtattatatttaggtgcttttatcgtcaggttataagttcctgagggaagatctaccgtaaaatctccattattatctgttactgcagttttctgagcaatactcacctcagctccgatcacaggattccctacctcatctacgattttaccggaaatacgtccgtttcccggtacagaaatgttagaattttcatattttatcgaaataagatcaccatgcagacggtacacaaccggaaggccattggtaatatccttcaggcagttgttgacagaagtattttcacatttcactccttttaccttcagctcttttatatctactttggaataagccagtctcatccccgtttttcctgcaaattcttccaaaacttcaatcaacggtctgttggctggtacagaaaatgttactttctgaaccagctcctgagcttctgcggctacagtaaaaaataaggctgctatggtaatcccacatttcaaacttttcatacttaaagtgttctcttgattatgattatttaatttttaatagtgattattttttcaggatataggtgttttcttttttctgcacttccagcccaaggataaaagccagcgattcaatattttcaccgacctttcctccggtaaagtctgccgtgatttttctgtcctcagcttctttaggatacaatactttggtgttatagctgttttccagaacagttaccacctcttttagcgggacatcattaaagcttaaagacaatattgaagaaaccttgccggctgatttcctgactggtttcaatgatatgaccgcagttgtatgggcaatcccgaaattggtccatttttgattcggtgtaaggaaagaaaccggaactcccggagaagatacagccaccttcccttcataaagatcaaccgcttttttcttcccggattgtgaaattttaaatacggttcccaatactttggtgctgaagccgtctgcacgaacaatgaaagggtgtagttttgatttggccacggagaatatggcatccccttttaaatccaccactctggtatccgcaggaaatgattttgctacggtcatttcagctcccggtaaaagggtaactaccgatccgtcttcaagatgaacagtacggtttcctgatttggccatataaacatcaggcctgataaacatggtgtaggtgaaaattcctcccaaggacaaaagcagaataataaccgcagcaattttatataatagatgtgtttttaagttttttgcagatgaaaccgaaataatatctgttggagaaaaataatgttccaatccggataaaaccctttctttagatgctttcctatgaacagcatccagttctttttcagcttggattttccattgttttaaaagttcattttctttttcagaaaccggatcttccgaaacatcccgttcccaaagtctgaaaacaaaggcttcaatatttttataagtcaaatgttttttcatagagtctttcatcgtattcacaaatacttctatctataagacagtgaaaatgaaaaacttccccggggcattcttaacgttatattcacattacaacctaattgttaataattttcgtactttttcacatttactcaacattaacatcccatttaggcctcttttttcagaaatatttaatcttaccatccccaaagttcacaaaaagttaattttcctttaggtaattttgtaacagaatatgagcccaacagactatacattattaaagaaaataaaatcaggtgaccgccctgcatttatgctgctgtatgaccgatactgggatagtctatatagctttgtttttgtacggacccgggataaagaaattactgaagaaatccttcagaacctttgggtgaagctccttgagcatacagataccatacagactgacgattctgaaagtgcaaaaggttatcttctccgccatctccattaccggattattgatttttataacagctataaaaagactcctcctacgctgagcatagatgagtttgatattccacatgaaattgatacggcggatacggattattttgaaatccttgaggaaaatgaaatttctgctttattactgatgattgatgaagtggtttcccggcttccttcaacagaacagcaggtatatgatatgagaatcaggaaaaatatgtctgtcagcgaaacggcagaagcattggggctcagcaataaaactgtaagtaataaattaagcagagccttgggtgaaatcagggaacagctgaatcctgagtatcagtcatctaaaaaactggtttctatcttgtttttgatggagattttgacgaggtattgagatgtggttcgggatgcgaggtgcgtggttttgtgaatagtcaatttgctaagcagtcaattgtcaatttttataatgcctatcaaaattcacagcaaagcggattcaccttttaacgtcaatggtcaatttgctatgcagtcaatcgtcaatttttataacgtctatcaaaattctcagcgaagcggattcactattcactattcactattcactattcactattcactaaaaaccggcagtgatgcactgctaaagctcggtattttaaagtcggcaaggctggagtttatattttcgtcattatttgtgaaaataatggttttcattcctgctgcttttgctgcttttaatcctgaatggctgtcctcaatcgcaatacagtgctcaggagaaatcccaagattttttgcagaagtaagataaacagcgggatgaggttttccctggatttcgaattctgatgaatgaatggtatcaaaaagatctctaacctcaagcttttcaagaacagcatgggccacccgtaagggagcgtttgtagccaatcctattttataatcattgttcttaagatttctgatgaattcctgaacaccggacattgtacaatcattggtgtgtatcatttcaatcaccctggtaaccactttattttccagatcagatgcatcaaaattttcccatgggaatctttcataccagaattctgttacttcctgtgttgtcatatactttgtttgtgcggcaagttcttctgttacctttacgccataggatgaaaaaacatccagctcggcctgggcccagaatttttctgaatctaccagtacaccgtccatatcaaatattactgcttttaaagccatattctgagttatgattatgaattaaatgataatgattggctgattttatagacacagcgctgtcccccggaaataatatgatctattctttccactttatagtcttttcctatcagggattggaaattggatagttcggcacggcagaaaccctgacattcagcggcggcagcacatatcgggcaatgattttcaatcagaaaataattttggccttcttttttccattctgccatataaccttcttcacttcggacttttgccaaagattcaagacgctgctccaaagactgtgttttggaaagtattttttcataacggtcgtgagtgttcttttcgcggtcgctgatcagcaagtttaaagcattttcacccaaaagatttttcacagatttcagaagctgaacagttacatccgcatgggtatccggaaactgagccaaccctttttcagtaagagtataataagcagatgggcgtcctacgccttcgcttttcaccgaagaccggatcaatccttcctctgcaagattcagtaaatgttttcttgcaccttctttggtaatcgataattcttctgcaataagaagtgaagtagcttcccctctcatctttaaaaacatcagaatacgatctgcagccggtttcttcatttgccaatatttaggttgttttattttccaacaacaaatatagtcattttctataacctcaaaaaataaagcttaaattaaacatttacaacactttattattttcattcattactccaataaaacaacaataaagttgttttattcaaatatatttttacctttgtcatacattaattaaaaaaataaatacgatgaacccatttacattaccgcagttaccatacgcttatgatgctttggctccgtttatagataaagaaacaatgacgattcatcatcagaaacaccaccaggcttatgtagataatctgaatgcagcgctggaacaaaccaatgaaactaatgctgatcttgattcgctactgcaaaggatcagtgagtacagtccagctgtaagaaataatggaggcgggcattataatcactctttattctgggaaattctttctcctgaacctaagttgaatcctgaaggtatgcttcatgatgacattacagccacttttggaagtctggaagaacttaaagcaggaatgaaaaaagccggtctggctcagtttggttcaggatgggtgtggctgtacgtaaaattcaacggatctctggccatcagttctactcctaaccaggataacccgatgatggacattctttcgatgaacagaggttttccgattcttggaatagatgtatgggaacatgcttattatctgaactatcagaataaacgtgcagattatctggatgccttctggtctgtactggattggtctgccgttaagaaaaaatatgaagaagcgttgtcaaaaataagatagttaacatgaatttttaataagctatgactgaggaaatttttatcaataaggcaaaagcttcaggcattattgcttttgacctttcagactacaaaccgacaacggaaattgtagagcttgatattaaacatcatcttttcatgggaatgattgtcaaggaaaaagaatttaaagaatccattgctgaagtagatttttctgtatatgatgaaaaagcagtaggaattatctgctctacagaggccatcgtcccgccctgggcgtacatgatgatcatggaaaagctttttccttacgcttcttacgtggatttaaataacgcagaaacaattctgcttgatctctggaagcgccgtctcatttatgctgatctgaaacagtacagaaaccagaaagtggttgtccgggccaatgccagccatgatccttctttgtatttgttagcggccggactgctgaaacctttggttaaaactttaatgtatggcgaaataggactgcccaaagtaatttttaaacaataaaaaatgaaagcaattatattcaacggatcactggaaagaagaaccatatctacttccggactgatttcggattatttttcagagcggctgaaaatgtcaggcattcagactgatatttttacacttgcagattccggaattccattatttgatgttacactcaccaaaactcccttggcagtggaacgcatggttcagatgtttactgatgctgatctgcatatatggctggctcctctttatcatggcagcattccgggagtgatgaaaaactgcctggactggctcgaagtaaccgctaacagatacgaaccttatctcaccgataaaacagtaggaatggtatgctgggcagacggcctacaggccatgcagggaatcaatacgatggattctattgccaaatcgttacgtgcctggccgctgccattcagtgtgcctgttgtaagatcatcattgtttgcatctgacaattcaacacaaatttcggatctctattccggtaagtttgataagcttatcagcattgcaacttctaaaaaaatagaaagttcaggattaacaaaatcagcagaccagctgtcagactgatcttgccgtgtaagtggatgatttgttggcagattgatgatttaaaaataaaaattagcacgctttatgctgcttattttcaaagaacagtgttgaactgctataattaagtttaaggggatttccgaatcgttctccgtggaagaaatcccttttttaaaccttaaaatttcgtgatatggctataaaaataacagatgcctgcatcaactgtggagcctgcgaacctgaatgccccaattcagccatttatgaaggagccattgactggcgctggaaagataagacaaagctttcagggcatatcaaattcccggatggtacggaggctgatgctgatgcatataatgaagcagtttctgatgaagtctattatatcgtttccggaaaatgtactgaatgtaaaggctttcatgaagagccacaatgcaaggcagtatgccctgttgactgctgtgtggatgatcctgatcatcgtgaaagtgaagaggtactactggagcggcagaaattcatgcacagtgcctgaattgtacccaacattttgtaacaagaagccagcattttctacttattgagaaacacaatatcagtcatttaaataacacctgtattatatgaaaccgatattattttttcttgccttactgccggctttattatccgctcagacggatattccaaagatcaaaaaagaatacacccggcttttagaaacttcctcatatggaaacaattcaaaagccggtaaatattatgatgtcaatggaatcaaaatgtattgtgaaacgtatggccagggacagcctttgctcctcatccacggaaacggaggatctattgtagatttttctaaacagattccttatttttcaaaaaaatataaagtgattgtcgctgacagcagagcgcatggaaagtctcaggataaaggagaggcacttacctatgaaatgatgtcggatgattatgctgagctgcttcagaaaatgaaaattgattcagcatttgtcataggctggagcgatggagcgattaacgggctgttgctgagcatgaggcatcctgaaaaggtaaaaaaactcatcattacaggagcaaatttaagaccggattctactgcagtacaagcagatgtattcaaaagagtaagcagtaattattcaaaatttaaagagctgtttgcccagaagaaagataaaacagatctggattatacggttctaaaatataaaagattattaagtgagcagcccaatatagatcctaaggcactccacagcattaaggttcccgtccttgttgtcgggggagattatgatgtcatcaaaccggagcataccctggaaattttccggaatatccctgaagccaatttatggatattacccaactccgggcacagtactttggtggtatacactgatgaatttaacgccaaagcagataatttctttaaaacaaaattcagaaccattacagaccgcgaccgggagttctgacataaataaactctgaaatttcaaaaatttcaatattttatatttaatttcaatagaggcgggttttaacccgccttcttatatttctttttctttccgctttagattctgtgttaacttccaaatattttttatacatttatatttataaaagcgaccttgagttagcttgcgtagggtgaaggtctttgatttttaccctactttcttcaaaatctgtctggt

SEQ ID NO: 21 - DNA, 194098 bp, Chryseobacterium sp.
aaaggaataaagaagtgaggacatttctaaaatatacttcctgagttatttagccaaaactgttctctcaccccttttgctttgtatgtaaatttattcttttgcaaacataggagccaaaacttatttggctttaatctcagtataaattctttgagtaaaaggagtttctgacccgacctcaacaccatatttcaatacagctccagcaaacagctccagttcgttttctttctttcctgaattgatatcaagctgtaaggaagttggagtttcaaaaggaaatgtggaagctttttcgaatgtcttatcaatgatatcttcctgaagataaattccttttttatcggcaatctgctgtatttctttcataatttctgtagcttcctttttctgcggttcatcagtacagacacttcctatggaagaattatgtttagcagttaccagtccgaagctggcaatgaatatgaatttcgtccagatatccgtttgtgaattgtctttaaaatcaaaatcaattttactttctttcaggagttctgtaatccattctgcaggagcagaaaaatgcgcaggatctcttccgataatcattttccctgcttttcccttatgttctacaattcctctttctttaatatgggaagccacatagatacaggttggaagaacagtatgttcagggattatttttcgtatcctgtcataaatatccgccccgttcatcataggaagcaatatggtattttcattaatgaccggaagcaactgccggcatacattttcaaggtcatattcctttacacagatcaatacaaggtcaggatttttaatatcactgatgtgctgtaatatggcatcaggatgagtctgtggatgagaatgctccggagataacagagtcaatccgttttcttttaccttctcatacgtttctccgcgggcaataaaggaaacattatactttcgggaagtttcattggcctgattgattttaaaaccaaaatatccacctacaccacctaatcctacaacgacaatatgttttttattcatgaattatttttaagcaaatatcagcgataacatctgatataccacttgacaaatgaaaagaaattatactttgtaaatatcccttctgatcctgctcagtgagctgtctttaattccgagataagaagctattacttttaatggaacataccggaaaatttcaggatctttcttcatcaggctggcatatcttgtggaagccttctgactggccatttcaatcagcctgtcatgaatattataataattaagcacaaaaagaagcctgctgaactccctgaattctggaatattatgaaaattatgctgtacattctccaatcctgtttcccagaaaatacaatccgttacggtctgatatatctctttggttggctgctgcctgaaaaaagacagaaaatcattaacaaaacagggtgccgtataaatatttgttgtgatttcctcattatcttcgttcagaatataggagcggacatatcctttttcgagaaaataagttttggtgctgatcacatttttatccagcaaaacagtgtttgcctttaactcaaaacggctgaatttttctgtgattttttcaaccacttcttttctgattgtaaataaggaatgaaaataggtgttaagtgatgttttgtccattaaaatgttctcataaataaaattgagtcatctaaattagagataattcgtgaaagtctggttaatcagatgctttacaaccaccccgtcaaaaattctttgaattttcgccacccctccagaggaggggaatctttgcatcaaacggaatgatatctaataaaaaacaaaaaccctttaaaccttatgtttagagggcttttatttttttgtaaaaaagttattcttcggagagaacttcatcataagtaacaggatctgtaacctcctgatattgttcccattctgcttcaagctgtttattggttttcatatcttcttcaagcttcaaagtttcacgatattgttttgcttctgctgccattgtccatttacaagtaattcccatggaatcaatataacttctgacatcgtgaatatttaatctaaaaaactcttttcttggattaattttattaagctgactttttaaaaactttttatgaagttgtttttctaatgctggggcgtcttcagcatatatcatggcatgaacatcgaactcaaaagggacacttgcatctccgagctcacgaacacgatctaaaggatccaaacgtcttgtcataccaattttataaacatcttctccaaatgaaccgatatttgaaataacatatacatttccggttctggtctgctgagccattgagattgctcgttgatttttctcttcggcctgaataagtttttgctgtaattcttcaagttgctgctgaaaaagtatcttttgttcttcattagctctggctacctgagattcagccttctcaatcagtctctttaaagtttgttcttctttttcagcctctttcattgctttttcatagtctttacgagctctttcttcttcccggatctgctcacgaatttgtctttgctcttcctgttcctgccatttcaactcctgagcaactacagcccatcttagttcttcaattcttgcactatgataaacttcagatattctcgcatttctaaaagcctggccattaaaattaaccaactggaaagcatcgtccatcttttgtttcaatattccaaagttatctttctttactgacgctaaaatagaatctacttttccgttataggcatcaataacaaaatcaatagcagtatttcttcttgattcatccatataatcacagataccagcctgtctgctaacaatcattagtttattgttatgcctaagctttttaagtttatcaccagcttctttatgactgaaatcttccgcaagctcatccaataaagtataagttggcacaagatattcattgccatatccttcaataacatttttcattgcttttattctatcagcaatctgatccgcttctcttaaacttctgtaagcatctcctcctattgattctgctctcaattcggcgttatctacaatacgtttcgcttcatttacagcattttcatacagtaattcaatctctcgtattttcttctcagtactttcttttgcattcctgcgaagctcgcgagcttcaagctgcgcactagaaagctcttggcctgccttatctcttaatctcaagctatctctttctgcttttttaagaagataatcacattcaactttaacatcaataatatcctgatactttctcaatgcatcattatgttgtgaaagttcaactatttttctgtttaaagtattattatcaagctgtaatttggaaacctctattttcaaacgactattctctccttttagatttgttatttgagtatctttttgaagagattcttttttaaacttccctgatgtactgaatgcatacagcatcaatataaataaaataataatcaataaaattgccatggttgaaatttttatcaggcaatattaaataaaaaatacaggctcaacttacggaaaaccgtaactaaaagggctatatttcaaagggcacaatctaattgaaaaagtattgtcatcgaatcacgaggaattgtgccgtactttgtaatttataacaaattttgtaattttcttaactaaaatcagctgtacaggcaaaattatggaaaatgacttcacttacaatttcatcgaacctgaccaagaaatcgcggattttgtggaaaatctgggaacatttcaaaatctttcggatgaagctaaagaagtggttattattcctgacggaagagttgatctttttttctcccaatcagcttcagagccttttcatgttacccttctcggtttagaaacctatcctgaacaaaggtatattacccctcatacaattgcttttgttgtaagttttaagcctcttgctgttgaatatattctgaatacctccattgccaatttactgaacctgggaaaagaacttgcccctgatttctggaatttcagtgcagacgatttaaaagatttcaacaactgctgtatgaaagctacccaaaagataaggcaactgcttcctgcaaaagcagatgaaaggaaattaaagcttttcgaactggtttatgcttcaaaaggtgaaatgagtgtgcaggaactttccgaaaaaacaggctggagcagcaggcagatcaaccgttattttaccaaacagcttggtttgtcgttaaaggcctactctactattttacgcttcagagcttcactggaacacatcgcacagggaagattatttccggaactcaattatgccgatcagaatcacttcatcaaagaagtaaagaaattttccggagttgctcccaaagaattatcccaaaataaaaacgaccgatttgtactattatcagtattgaaaggaaaataaatttgcattgtaaaatttaaattaacaatgctgatagacaataaatcaatagcaatcgttggtggcggtcctgccggacttacactggcaagacttttacagctgaaaggagctgatgtaaaagtatatgaaagagacttcaataaaaatgcccgtgtccagggttctccacttgacatgcacgaagattcgggtttggcagccatccgtaaagcaggattattagatgagtttaagaaaaccttccgtcccggagctgacagagcactgattgtgaatgaaaaagcagaaatattttttagtgatcaccaaacaaagcctgaagaagattttgggtatgaacattttcgtccggaaatagaccgcggcccattaagaaatatgctgctggattctctccagccagaaacggtagtctgggacagtcattttatctctatggaacgtcagaatggaggctggttgctgcatttcaaaaacggaacttctgcgtatgccgatcttgttattgcgggagacggagccaattccaaaatacggccttatcttactgatattaaacccgtttattccggagtgatcatgctggaaggaaatgtttcaaaggaaaatgctcctaatattgatgcaatggtgaaaggaggaaaaataatggctttcggaaacagtcaaaatattttacttggtcagaaaggtaacggagatattgggttttatgccagttttaaagctgatgaaaactggcctgccgcaagtgggctcaacttttctgatcatacccagatgctgaaatggtttaaaacagaatattctgaatggagccctgtgtgggaagaattgtttgaaaacgctgtaaccccttttattccgcgcctgatctattatatgccctttgatcagacctgggaagcccaacctaacctgaccttaattggtgatgctgctcatgtaatgcctccattcgcaggagaaggaactaatatggctatgctggatgctttggagttgagtgagcatttaacagataaccattataatacgttacgtgaagctatttccagctatgaagagaagatgcgtgaaagagctgccgttgccacacgggaatctctggaaaatggggaaaggatgcattctgatacttcattaacaaccatgcttgacttttttaatggtcattgagttctataacaaaggctgccttcaattgaagacagcctttttccctcttaaaaataattttttttctctccgttagatccagatacggagattcatatgtgttatttcttgatcaactttgtattataagtgttcttgtcatcttttatagtgatcacatacataccttttaccaaagaagcaacattgattctttgtccgtctgtttttccttcctgaacaagtcttccatctgcgctgtaaattttgtaatcacccttacctttaaagtttttcacttcaataaaggtatctgcaggattaggataaactgatatttcggatgattttgtatctgctgtttctctcacggcaagtgtactggcagtaatcttcacaggaagatccataatgcctcctgcctggctttccagttcgccgcacacatcattcggagccgtattgaagaacttgcctacgattctcattcttaataatttatctccggaataagtagttgttggaactgtaaagttaaggttacccattccaacatttcctgtaggagatgcgccggatgtctgggcgactttttctgatgcttcgaaaattccatttctgttataatcaatccataccgataaatttacctgcataccgctctgtaataaatttcctattcttggcgagattgtataggtattaccttgtgtcaaattaacaatcttggttgcatcctcacttaaatctttatatgatcttgctgtagcatctgtataatctatattggcaactgctactttcaaaattgaacccaagtaaggtgatcctgagtttaatatacagtaatccacacctgtttttaatccttttgttttaaaggtataattattagagaaagctccgggaacggaattgactacagccgccacctgaacttcataactggtttcatcttctaaattattcagaacagcagaattagcctggctaagaacattagaccagtttactgttcctgcttttctgtaattaacagagtaagtagctcccggaacactgttccaggatattcttgcggatgttttgaaaatctcagtatctatagcggcaattcctgtaggagacgctgtagaagatgtaggcgcactccctaccgtaacggcaggagacacggcataaaaaatattccctacagctgatattcttaactttactgttccgcttacattccctggcatttgtgcactatagcttccggtatttggcgttgcagctgcaagattcgtccaggttgtaccgttatctgtagtataatctattttcacactcgctgtattataaggggcagcatttgtattggcaacatcccagtagattgtatttaccgcgttattatacagtactgaagatggagtaagtccattgaatttgaatggtccgtcatttcctacagttacggtagttgttgagctggaaaccatcgggcgctgagcgttaagatctcttactgttacagcatagttcaatgttcgtgggatataggataccgtttcccatctttgcttatctgtcaggcttccattcatcacacttgcgaagtttggaaaataccttcttccgttgggtgttccgggaactgatcttgttaaagcccctttcggattgtatccccatccgctatcaccggaaattgtagaaaattcatctgtactgtcattctgttcccaggtgtaatttacagaatcattttcggcatccgttgctgaagcttcaagataataagccgttcctttaggaatgctataagcaaccagaggattaatagccggagcagtgttattgataatattttgagaaactccgcaattaagtttattttctaaattggttaacacctgatcaattgatttataatggaaatatccatctgcattagcctgaacattatcataggtaattccggcatatcccataattgttgttccgccgccaggctccacgttggctccctgattggcatctgtgacagaagtatttgaaaacgtatggtttgcgcccagctgatgtcccatttcatgtgctgcagtaaaatcaaaaacctcacctacgggcacaggtccttgtgtataggcagaacctttttttatttcagtattcgttgcgggatctacgcagacaatgccgattcctcctgcatttccacttctctccgcattctgattaagaacatgcccgatatcataattggcatttcctactgctgaattaagtgtttgctgtaattgaagatttaaattacctgtataaggatctgttgccggatccagatagataatctgcggaaaattctgtactgttaaatgagctccaaaatcacgctcaaaaacaccatttatacgggtcattgtattattcatagcagccagaaccactcctttttttacatcatctgttgcattggccggagttcctgcagctgttaattgatactggctgtattctcctgtaacggacaatgccattctgaaatctctgtattttgtgttggtaggtctgctggtaattccaactccggaaagcatttttttaccattctccaccaatttattaatattcttaaaatcatgttcttctgtgtcacatttgaagccatgttctccatcgttctttgttttatagaatactccgtaagtctgcttatctgcagtaatgggttctataaactgaaacacaccatcctttatgatcatagactgcatatcaattggagaagtactgaaccttaaatacttggaaggatcatctagtccaactcccacataagatcccaactgatatttttctaccagagatctgtccatcacaggattgctatacactgcaaatttttcaatcttcccttctacagttggtaaagaaataataacaggctttgcattttttcctgtttcttctgcatttttaagcatttctctaagagatttcagatctaccctgtaagaatactgtacttctactccttctcttatctgcgaacttttttgagaaacagattcccatctctgggcattgaaaaccgtaaaacaagacgctaatgcgcaaacgaataaaattctttttttcataaatatatttaagttattttgatagaatgctgaaaattttagtaaaacgacggacaggtccgtcattgtcataaattcaataaaatgaaattaatcatataaaattcacaacaaaactctctacaaaacttatatattttaaataaaaaacaaaaaaaaccgctactacacagatacaacaaatacattaattatttgactatcaataaattatattatcaacaacttgtatttaacaatattacaatcttggaatcattaaagtttcaatcagaaaagttccttaaagacatattgaaaatcagaaagaaaatagtacttaaatgatacttatgcagttattaaaaaggataaatgatgaaaagtgagagggcaaaaaataagtaagttaagaatgaactgcagatttttctcattcatagataaaaaaaccggataaaacacaactatctacatatcaacagcttagaataacacatacgcgatgtagtacccgtgtagtatcgatttttttcatcttttagttaaaaattttcatatttgacaccgagaccacgaaaaaatccgagtggtgaaaagagaatatttcgagtactgtctgacctgatgaatcagacagttttttttattatgccagggtgtcaaagaaatgataaatatctgtttctttgggaatgttcagtttttttctgattctgtattttttctgctgaacacttctatgctgaaccaaagtataacttgcaatttccttagatgtaaaatgaagtttcagcatggcacaaaaaacaagttcagaattttcaagccccggattaatgattaaaagctgatgtataaattcaggataggcttctttaaaacgatccagaaattcaggatcattttttttaccaagctctataatttcctcctgcttattgtcattcattcttactttgaggttttcagcttccatagcgagaatttttttccgttttcccaacgcaataataattctccaggcatatagtcccaacaaacaaagaccagcaaacgagaggaaaaaaatccaatataccttattctgatggcggtcagcatcttgttgggcttctgtaataaaggatgccatatcctggttgatagcagccagcaaagatgtattggttttgtaaaaagcatccgtgtacttcttcagataaaagtaggccttctccttatctccggttttttcatacaataccctcagatcattatagatatattttccataataggcgtagatacgctttgtcttttcattgatttccaaagctttaccaaaagcttcctctgccttatcatattgtttgtttttgagaaaatattctcccattatggtatttgcatagagtgcaataccatctgccttgcctctcatattggctttgttgtaggcaagcgttatatatttataggcagagtcattatttttatgcatatagacataatcacttatagcacagtctgccaaacctgtatcatcaagcttttttgccctatggaaatattcgagtgctttattataatcctttttttgaacgagatagattgcctgtcttaagtaaatactgaaaagaagatcatttttgagcggcgacggatcgcttttccggataaaactcatcgcttcatcattatactgaaaagccttatcaagcctcctgagctctacattgaagcgaccgtaaacattataaaatctggctttatgaatgttgtcatctgaagcatccagaattttctttgcattatcaaaaagaatctgggacttcggaaagttctccagtgagatattaagttctgccagattgatataacataaagccttgccgtctccataattcatcttatcggcctgtctgtaatatcttttattaagatcaatcaaagaatcatagtttccggcaagccggaatttttcattctgtttcagtaaagacacgtcaaaagctttttcagtctctttttttgaatgagattggcacgaaacgataataacaagtaaaacggcaagaaaaatatgtctcatatgtttctttatttaagctacattcctatttaaataatgtttaataaaatgattttctcagaatagagagtgtttatattttacattttcaatggttatttccggcaggtcaacagtggaatctattgataaacaaaatcctgcaggttttattgtgatcagttactattatgtcagattttcaagaaaatcgtaaatatccgtttctccgggaatgttcagcctttttctgatcctgtactttttctgctgaacagatttgtgctgtacaaaagtataatctgcaatttccttggatgaaaaacgtaatttcagcattgcgcagaaagcgagctcagaattttcaagatccggattgatttccagaagggtttttataaattcaggatataattctttgaacttcatcaagaaagaagagtcattctttttggccaggtccattatttcctccaattgttttgcctgaacatgattcttcaatgcttcagtttgctctttcagggtatttttctttttttgcaatttattaatcagcttctgtacatatactcctgaaacggtaagaactgttacggaaagtgcaataaatagcggaagatcatttctatgccaatcagattcctgctttacttctgaaataaaatcttcggtagctttattcatggcggcaaatctggcagcatcaaaacgcttctcctcttccatatatttcttcagataaaagtaggctttgcctccgtcattttttttcttgtacacttctgcaagtgatttgtatacgtcttttatatgtgaagaataggtacgtcttgtcctgatattaatttcaagtgcttttttaagagctttttcggcctgttcactgttatcaatttcattataataataccccatggtataatatacccaaagcgattccacatctgttgttttctgactcagcattttttcatctgccctggcaatgtatatccctgcagaatcaggtttatgggtatataaatagtattgagccaccatacaattggtataggccgaattttccagtgtatttgccttgatgaaacattttagagatgttcccagccatcctttccatgcatagtaaatgcctttgtttacataaagcctcggaagaagtttctgagtgagttttgtattttttgcctgttttaaataataaaatgctttgttattgcattctatagctttatcatatactttaagatgtgagtaatacagactgtaatcatcatagaacgttgctttgtgataagcattttcagaatgtatcaggtctttttctgctttactgaaaaaaaaacgggctttttcataattgcctgcggatacattgactcctgccatattaaggtaacaaagtccttttcctgctgtatatttcattttggcagcctttttcagataatttttatttaaactgacaaaggcttcatattcaccggacaattgcagctcagcgctttgggttaataaggaaacatcaaaattctctttttctttgtcctgggtattacgatgacaggaaagcaggcatataaataatcctatacagattgtatagtttatcattctctttatgtcggttggatatgtttttttatacttaaaatcaatttttcccatgccacttttccctgtatctaaatatctacctatgcatatttattgaaatatgcagataaatttatgtcataatttttccccaataagtgttataaatatacataatttcctaaacttattatgaaataaacaatctgttttgctaaaatgtaacattaaaataaagtaacaccagttcccttaaacatacatttttcttaaaattttcagataaacagcgtaaatattctaccttaaaaaaactatgctttaattatgataagactacctgaaatgaaaattgttacaaatagattaagtgaattatttaaaatttagtctgcaagccagaacagtgtgtacattttgtatgttgatataaatgaaaatagccaatctgctttttatgaatattgacttttcatcgtcacaattgtcagattcaaagtgcaatttgtccgatttatcatattttctgaagaatatatttcaaaagttttgaaatttgaataaaaataacagatatgaatcgttttttcaaaaaattaaaaacaaaaaatatcctggttatagtacttgtaatttttattggaatacaattttacagacccgacattaaaccagagcctataaccggtgagattcaggttcccaatgatgtaaaagccatactacggcggtcatgtttcgactgccattccaatcagaccgagcttaaatggtttgaccagattgcccctgcttcctggctggtagcagatcatattaaaaaaggaaaagaaggactgaatttctctgaatgggataaactggcacctcccgtacaaaatgcaaaactttgggagtcttttaatcatattaaactgaattcaatgcctcttaaaagctatgaattggttcatcctgaagccagactttctgaaaaagatattcagatcctgaaaaaatatgtattttctctggctccaaaagtgcctgatacagcaaaggctactgcctataaaaaacagcttcagcaggtcagcacaatacataccacagaatcaaaactgttatttcctactgcattaaacggaatcagctatattcctgattataaaaactggaaaccgataagttctaccgagagactggataatgggacaatgcgtattatattcggaaatgatattgcggtaacagcagcaaaggaacaccggacaaatccatggcctgacggaagcatactggcaaaggtagcttgggaccaaatcgttgacagtgatggcaatatcactaccggagcttttaaacaggtggaatatatgatcaaggattctaaaaaatttgcctctaccaaaggatggggatgggcaaggtttttatctccaaaacttgagccctacggaaagacagcagactttgctaatgaatgcatcagctgccatcgcccgatgaaagacaatgatttcgtttttacttctcctcttaatcattaagctatgaagaatccgattatttatttaatactgtatgtatttgtattgagctgtggctccaaacaggaatacgaatccgtgaatgagaaggcttcccttcctgaaaagtttgattttaatgccatgaacttaaaggtagtcacttcttcaatcaatcataagaaccagacaatgatgactctttatggtaataaaccagcaatggaagagctaaaagacaaacccgaaaaggaggaaagtaaagaaagaatactggccctgattacctggtcacaaaaagaagacccttattggtatggagcaaaaattcctgatcgtctgttgtctgtagaagttatcaaaagcagatatccgctgtcagacaattttgacattcagtataaaaaatacgaaggaccggcacttaaaaaagtatccgcaagcggaactgaaagaatccctgcaattcttaacatgaaaccttcaataatgccctagccgattttcaaaaacacatataaaatgatattcactaaaactattaaaatggaaaaattcacattcagttcaaatcttataacaggatgcatttcagcgttactgtttttgacctctgttgcatgctcaaaggacaatcaggatgagtcttctgaacctgctgtaaaagaagtgcagttacggaatgatgccaatcttggaaatatcctgaccgataaagagggacgtactctttattattttgccaacgatgctactgcagcaaacaattgtacaggaggatgcgaaccaatatggcctgtcttcaatgtggataatctttcatctgaaaagttgggaacaggattagaactctctgattttacaacaataactacgggttcaggtaagaaacaggtaacttacaaaggacggcctctttactactatgctcctttggtaaatggtgtcaacgtaaaagaagaagccgggaaaaccggtggagaaaatattggaggcgtatggtttgttgcaaaacctgattatacgatcatgcttaccaatgcccaacttataggacatgatggaaaaaattatacatccgcgtatacagaaggtacaggaaaaactttatattttacggacgctaaaggagtaacactgtacacctttacgaatgacaaacaaaataaaaataattttacggcctccgatttctcaaataatggagcatggcctatttatgaaacggataaaatagtggtgccttccggactggacaaaacacttttcggttctatcacagtatctggaagaaaacagcttacctataaagggtggcctctttaccgtttcgggcaggataatatgattatgggatctaacaaaggtatctcattcccatctccgggtatctggccggtacctgtgagtaatatggctgcagctatgccttaactttgtgttttcataggaatctaagtgctaaatagcggaaaactacccttcgctatttagcttttgtatctttataactgcttaactttctgatttttatttatgatttatgcaaagtatataaataccaacggaaaaaaggtattcaggattgatccgagaatcattctctttagttctctttttatgggaattctggcttctgtgcccaaaatactccgtatacagataaccctgggagagctaatgattgatttttccatttcgtttttatattccttatttgtttggtattttaatatttacagcctgcctaaattttctattcagaatatatcgacaagtttctttaataaaaagcttttgatcagtctgtcacttggcgttgttgtgatggctgtcctcgtatttttacatcacattatttttccaaagtatgggtataacaccatgatattgatgtatgaattcagagctatactgattaatctgacgatttatatgtttctgtatcttttgtatcagagctataattcccagcagatcagcttggagctggaacagatcagaacagataatcttcacgcccagtatgaactgctaaaacagcagattaatccacattttttattcaacagtctcaatacattgaaatctatgattgatataaaagatgaaggttcaggagattttgttgtcagactcgcagatttttaccgttttactttagataacagaaagctggaccttattcccttaaaaaaagagctcgccatactggatgcctatgtttttctcctgatttcaagatttgaagacggcatagaatttaaaatagacattcaggaagaactattgaattcctacattcctccatttaccctgcaattgttgtgtgaaaactgtatcaaacacaatattgtgtcactggcacatccactgatcataaaactatatagtgaagatgaatatattattatcgaaaacaattttcagccgaagaatacgcctcaggaatctgcagggataggaattgaaaatataagagaacgttacaagcactttgctgaaaaagagctgatcatcctgcaaaatggcatcaattttaccgttaaattacccatagtaaatgaaagttttagtaatagaagatgagataaaaaccgcaaaggctttggggcggatgattgttgcagtgcagccggaagctaccgtagtgcaatatattgaaagtgttgctatggcagtcgcctatctttcagaaaatccaactcctgatattatatttatggatattcagctcgcagacggaaactgttttgaaatattcggccaggtcagtataaaagttccggttgttttctgtacagcctttgacgaatatgccatagaggcatttaaaagcaacggagtagattatatcttaaagccttttgagaaaaaagacatcgaatcggcatttgaaaagatagagagacttaaaaatttctttcagcactccccttctcctgaccggcagctggaagatatattggccaatctgacaacaggcagaggtaagaccaattttctggttttttccaataataaatacagtaatattcctattgacaagattgcctttttttacagccagtttggaagcacagtactggtaacttccgatcagaaggagtattcaataccgcagtctctggatgaagtgggacagttggtttcggcagctcaatttttcaggatcaacagacaatacctgatcaacttttctgcaattgtggaagtggaacattatttttcgcgcaagcttcttgtcagtttaaagattacaactcctgaaaaacttctggtgacgaaagataaatcctcccgttttcttctgtggcttgaagaacggtaaaatcattctttgaaagcctatttctataactacaaacaacaggttaaacaaaaataaaaacggacaaaccattgcaaaatatttttaggtctacttggttttgtacgattttttaaaacaactaattcatccaaaatttctccaaccttttctgaactatggcttacccgttttatctcctgcaaaactttctgatacgctttatcataacggcttccctgagctataatctcacctttatacaccaaagcaaattttctgttactgcttattgagcctatagcatcaggattaacacctcctttttttccaatactctccataatagcagcggcattatgctccataaagaatgtcccgttttgtatcaatgcatcacattctgatgtttttgaaatgaaccatgcactggtaattacccattccgttggattaaacatacgaaggtctttcctttgaaaaacgccgcagttcaagtccaaactagtaaacagtataaaaatgaataatccgctcaattgattgagcggattattcctagtcttcccctgtaatacttaaataaataggtttattttcttccaaacattcttcacatattttgtatgctctaaaaaaaatatttatccaattatcctgagggtttttacccaaaggagtaaaatttatacctataattttacccgaaaattcgatttttgttcttacatccggttcaggaattcttgttgataacaattctttgattttatcctcaagaattatttttaatttttctgtttcttccttgtttaaaggttcatctttaaaaggaatttttgataatttttctttaaacaaatctaaagccaagccttccgcaaaagcgaaattacgccatgatgcgcctttatattcatcatttcttgtccattcatctattgttttatcacctttgatagtgttatgtatattaattcgcataaataattattttaaaaagttaagttccacataatttctagttattttctcatcgtccaaaatccttattctagtaaatccaaatttcttggcttgttttcccgcaaatgttgaaaaagcagcctgttctatactcataccagcatctcttgctttccaaaactgatccaaattgatggattgtccaccataatcagtataaatatccgccttgatccaaacgcttacagttccatctactttcccatacttttttgcatttaaaaaatactttaaaccgtcctcatagacaatctgccctaatgcagcatatttatctgtaacttcttttggaatattcagatcaccatataacaaatgttctccttcttctattggtaaacctcttaatctatatttatcatccaaaagtttaatggtacttttaatatcaatttctttacctctgtatattaatttataaaaaagctcatttctattcggtgatcttgtaagctgcccaatattattaccaaattcatcaaataaattaaacaacattttaactcctttttctggtgcttttcctaaaagtgaaacatcttctacagatacaattcttcttcggttgacaatggtttctaaatattctccaactttctccgagctataacttacttttcttatatcctgcaaaactttctgatacgtcttatcataacggcttccctgagctataatctcacctttatacaccaaagcaaattttctgttactgcttattgagcctatagcatcaggattaacacctcctttttttccaatactctccataatagcagcggcatcaagctccataaagaatgccccgttttgtatcaatgcatcacattctgatgtttttgaaatgaaccctgcgctcggaattacccattctgtctgttgaaacaggcgtaaagaacttcgttcaaatcgtcctgcatttaaatccaaaaataaggaaatagcggaagctttcaaaccctgctgtacattttttgcagctttgggcagcaatacaaaaattcccctgtaaacagaaacaataagctgtggtgcagctacaatagctccgccaactccatagataagatcccagtctttcagaaactgttctccacctggaagctttcttatctcttcccgaaatgcctgtatggtaagatcaggtaatgccaaactaagatctgctgcggcagctaataacaggtacgggtttcctgtagtagcaagagttcctactcccagaataatagcggcaatatctgctgcaatacgcaatctatcgtttattattgcccacttttctgcatctgctaaagcttttacataaattgccggaactttcgtaatcgtagtaaccccatcaaactcttcttcaagatacaccatttctaatggcaaaaactgccttccttcgtccaagtctttgtatattgtttcttgcgtgctgcttttagcaattgtacttaccccaagatcatctgttacgtaattttcttcttcaatgtattgttcctgctgttgttgcagaaaaaatgtttcctcatcagactgaccaaataatcctaaaatagttcccgaaagttcgttaactttagtgtttactctatagccttttttaattttaaaaattggtgcatcttcttttatcgtgtgatgttgtgcgaaagaccgcataattccggcaaaaatgattcggttagattgtggttttccatctacataacttatatcatctaggttataataaatcctgttgcaaagctcaggttcttttttgaaccgattcatgatgtaaccgggagaagaagttttgaagatatttaccaaggcagaacttccgtctttccaaccactaaaaaatccagtatcatcatattctgtaagagtgataagatgctgcatcaccttttcgttatccaatgctattctttcaaaaacaaaatccggagtattggtataaagaaatattaactgttccggagtactcgcttggttaaaatagaattcgtaaattttagaaaaatatccgagataattatatgaagtgtctttttcaaaatcaccgtaaccaacgtattgtattaaatttttaaattcttcataagaaaaagtttccagcataattgctttgtttctacgcagctcttcagtgtctgcatttctgtgaaaaaaatattttaaccggaaatatagttttcttacatttaaatctatatcaaactctatttcattttgtctttggactaaatctacaagttctgtatttttactgagataagtttttaatcttattatgttttctttattgtctttaattgacgtttgttctgcgtgccaatcataattattaacatcatagtctaaaatataataattgaaaagagtatttcttcttcgaagttccgagcacagaaactgtttgttgataaaatcatccgttctccaatcttctaatagcttttgtggagatattagtttttccattttctttgtttttagttgttaaacatttcaattcattcaaaggaaaaagttctttggtgaccatattctcggtgaatttttcagtttggttttcgtccaatatcaaaagctccaaataatattcttcatctgacagaagccttgcatttttaagtttgtactgtacctgtacctgatcaacaatctcagtattcttattgagatatgtttttaatcggatgatattgtctttacgccattctttactgctggtttctctaagttcaagtgtttccataattttttcttttttgaaaaaggcagggctttaaggccctgccagtaattaataattcttaagaaagtgcatctaggttctctttgtgtttttccacaaattcatccagataggaaaccagaagttctgtaaaaccagctttattgtttttcaggagccaaagcatatactgatagcttggtacttttaccagatcggtattcatatcatctccgggttctgcaacaggaagctctataagatgattgtctccgtcacgaaggtagctccaggtttctttatagatgagccattcgggagttgggagaggtatattaacttcttttccggtttccatatctttcaaaacctgctcatatcttaagcagataaactgcagtttagatttggcatcaatatccagcacccggatatgtctttcgaattgtggaagtcttggatgagcctgtagcggcagctctgcaagatgtaatggtgtattttcaatactgttaaggatttccttaatattttctggtataattaaatttttgttcataatttttgttttttaagacaataatatttttccaagtacactcattgttagtgacccttggccgccacttcctcttgagagataaaatctccttggctgtagattaaaggttgaattaaattgctgataagtcacgccattgctttccgcaattacatatacaattccgttataataagcaatgtgaaaggtttcatttctgattggcaaaagatctccctgataaatgatccagcttccatcacctccataatttgaaaaaccataaaatactccatcatctccacgaattccgccagaaaagggacctacgaaattagcaccaaaattactttggctattattaactgaaaaagagaccataaatccggcgttaatatctgagatggaaattaaattatccgtttgtgcagatgagccttgagcaattgatatagaagtatccgtgattgttgaactgcctgttagcatagtccaattagcaattcccgtaaacttactataggtaagtcctgcctttacaatgagttctggtgagctggcatttgttaacccattatgtgtcacgaataccttataatatccttctggttttgtactccagttgatcccaaaattcaaattattgggaaagttatgcatcactgtaaagttatctacactatattcttctggaactgccagattgataccgttcacgtcttttactcttttcactttgatatatgcgttggcagaaacattatctacaaagagatttaatcctactaatgttgtgtactgaataaagttctttgaattatcaataaacgggagcaataacacatctattcttggggctccggttgaataattctcagtagaaagtttcatacggtttctccactcagttttttcagcatcattcagcagcaggggataattggaaatcatattttttccgttactccatgaaagctgcccggacggattttgaaccatcattctgttaaaagttgtgtctgcagatttatcgctcagcccggttatcgaataataaaatccggaagcattaagggtccagttagcaccaagagttaatcctgcaccagaaacactagttaaagaggagtttgctatattttttcccaaatcacctgcaggaagtttagcaacatttccattatcatttaatcctatgattttaggataatcctggacagttccatctgtcagaggaatctctagtttcttagctaatttctctcttgttttgatattatacttagcctggcttgctattccttctgctaaaagatctgcatttgaaatgctgacatggctatcagctaattccaggggaatggtaccatcaacaaccgcatgggtttttaaatcaccgttttcgtcaacggcataatccgtgtaagatagagagccaggagctgctacctggtaaatagcattcgtttctctttctccaatgggaggtaattcattgacacgtataatttttcctataattggcattttttttatttttttagattaataactattttatttccagtctcctgaaataactttctgtccttccagcgattctactccaaggaggttgtcattggattcaaaattggttccgcagatttctcccaattcatcatcaaacttcactcccggctcacagttacaaggcaaagctttttcaactttcagcccaatagatcctgcctgaagaatggtaagagaagtaggaattttctctctccatggctctccttcttttgtcgcttttggtgagtgtaattcatccacaatggataagaataaaggatcatcaataacaggaacttcgcctccattccagatttgtcctgtggcaaggaaatgtctcaccgcttcctcgaatcccggtcttactgtaacaataactcttgccatccccgactgcataaaggctctgaaggtaggatcattatcatcaaactgatataaatctgcccaggattttctttctccccaataatagggatagaaataataactcatgatttcccattcaaatgcctgttccataaatttgataaatgcagcatattgatccagtttttcatctactttaatgtctgtattctgaaaggtttctacagaagcattatcattggtataatatctttttttaccaaacgtgagtaatgcatcaggactctggttcagcatataggagatacagtttcttcttaaaatagtattttctatttttctgtagaatcccggattggatcctttgatctgagcgcctacagcttttgcatctgccaatgcagtttcatatttgctgagctccactttataggcttcaataattttattgaatgctttctgcagccagccatttttatattcttcctgcaatacacatttgatattaaccgttgcatggaaataatgggcatttgttgttgcaatagtaataggaacctctcttacaaattttaaaaaggcattggacgcaccatttcctcctactaacaaactagccccatttccccaaccattataacctgggaatgcattactgctttgcacaacataggattcagtgatataatgctccggaatagcaataagatcagattttgaagaggcttgtttcgactcagtggatgagtaatcaatggattttccaacatataccacaggctccagcttttcatctacttcaacattataatagcccagccagtattttagttttgtagaatctgtaagagcactccagtctttgatttgcatcccggcggattctctcggatcaataggttttaccaattgattttcgatagcattacttaccttcattcctaatgaatgtaattttgccggctcaggaatcataaactcaaacatcattcgctttccatagttaaaaatctggtttttgactactttgtctacccagcggtaaactcctactacatgattgctgcctttggtattatcaaaaccatgtttgttattttcctcatattcttcaaggatcttatcaattcgttcttctttcactttggtgacaatcctttccagggctctggcagtaacatctttagcctcggtaacggcctgtctgttactttcttctttggaactatgagtagcatagttagcagcagtatttaacatgtatcttggagaagcacttcctccccatgatgcgttaaatcctgcctgggctgcaaaatccttagattcctgaagaactttagaaatttcactttgcatctcattcctttccgtggaagttgtatccgtcaatttctctttttcagattccgtagatttagtcgtttgagattcacttctttttaatcttcgtgaagatttttctctatactctcttgccataatattttcgatgtgtgaaacatctccttctacataacagtaagtactttgttctacctttcggtaatctgcaataccaatatttttcattccaaagcctgatgggatgaatggctgatcctcctcaggtgtggtcggggtatctttatttttcagacaaacgcttccttcacctgtcagattataggtttttgttactgaatcgattcctcctgcagtatatattgtcataggaattttgcaggtatatatctgtccgtcatcaagagtaagttctgcttcaagctggcagccattctttatagcatctgtaatttgcaactgaggtaaaatgccatcgctaaacagggatagataatctcctccgcctgctacctgtaattgatttgaggtttgaactacattcccattattatccaatatgttgatagttcctgaagctgatgaaaataacgacgtagtatcttgaggcgtcatgcttaataaccatctgtccgaatagttctgaaaagatctggtccttaacaaaacaggcaaacagttaccggtttctttattttttaatgtaaatgttccagacccttcaaatctgtaaatcctatctgctgtctgcaacagcttccctttcataaggtagacaagaccatcattaagagtaacttctccttccaatagtaaaatctcctgtttttccagactatcatttggaatatcctctccgttactgaataaagtagttacattgggaacatcataagtataagctaatgtaccgcttaccaaaatctgctgatcatacgattttatattataacttccgcttataatgtgtttaggggcgttaatatcagtagtcagaagcatagtatgacttccaaaacccattccccagcggatagttctggcaaaaaatgaaatttcctctgtatttactgattgtgtaacaggaataacaacccctcctaccgttgtagaaacctgcggagtaaggtttgtgttattcaagatcgtttgctgtagctgctggctgttttgttcgatggtctgaaaaagctctgtgaaggttgaaactttattcaatgcgctcaccaaatcaggagtaccaaagattcgttgcaaggactcgttatttccctggcttagttgccgctgcagatcttctgcctgaatttcaggacgaaaattaaaagtaaaggctttaacttccggaacaggaatatattttaaacttgataacccttcacgattatctgccgccaggaaaatttccttctgatattcttgttctttgacaagggcatcgtatctggcctgttcgggccttacctcttcctgatattgtttgtaggcagtattataagccgctgcgtattctttttgataattcttctcaagctgttctaaagttcttttaagttcctcattcccttttaaatttactgtggcttcagcaaatttcaaggcactatcgttaaaaggtatactttgtataatgcttttctctcttgaaacagccctatttgaagaagcagactttgcactaaaaagttccttaggaagaacaactttagcattaataacatcttcatactccgcttgagtaattccataataattggaaagaatatgatccagatgtaaaaattgcattaaagtttcctttgcataaaaatctttttgggtaactacctgataaataagattatcccaaatattagagtctatttcaatgataggttttggggtctccctgtaagccttgattttagcatcaaattcctctttggttgcttttactttattttttgcaacccagactgatagttcataaaattgtatacttttagctttaagggatacttctgtttctattgttaaacctgtgatcttttcacaaacatttttcaaagactctccggcttctactcttgggtcaattactcccttctgtcttagatagtttctgaaaataaatcttttctccctattctttggatcagataattctgcgctgcgcatcgttgcaaatctgaataaagtttgtgagctattattttgattaattgcttccattttttaattttgttttggtattttataaaaggttaagatctgaagctactttttagtagtatgtcttcaggttttagccttatttttttaggtggtttccggcaaaagatatccacccggaattttaaagtcaagtttcattttcgtgttttttcttgaagcaaatatccattagagaagcgacagaactcgtcgtgttaaattttactttagaaaaaaatgaaaccctgattataagagctataatctcatggagaaaacaacaaaatgagtttatagatagtattaatagaaatttgtcaacattgcaaattagcttgatcatcaaaagctagtgcctatttagatagtaaattagaatgatgtttgctaaatattagggttaacaaaaagaataaatattttcagcgattaatcttgcaaaagcacattataacagaaagtatgtttaataaagtctagcaagtactaaatggtaaataaagaaaaatcaaacccaaggtagtttcaattgagaatctacctttacgaggctttctgaaatgtcataaatgtggcaaaatgcttacaggaagcgcatcaaaggggaaaatggggatctattataatgattatcattgctcaagctcatgtggtgttcactttaaagcagaaactgcaaatgagcttcttgtcaaacaacttaagtacctgattccaaaagaaggaatgattggtatttttatagaagcatttattaaaaattttaacgtgcaaacaaaatctcaaaatcaggaaagaacaagtctactgagacaaattgaggaattaaaaaaattgtactaataaaactaagtaattagaagataaattaaataatttatgttctgtccatacggaaatcaaagatttatttaagttcggattaaaacagatagctaatctcgatatacggtatcagaagggcaaacagcagaaaagagacaaataataagttcgatgttccctgaatatttagaatttaatggcaaccaacatcgaactccaagattaaattctgctattcatcttatctatcagaatagcaataaattaaacagtaaaaaaaatgggacaaacctagcttttgtagatttgtcccaacaagtgacccggctgggattcgaacccaggacccatacattaaaagtgtattgctctaccagctgagctaccgagtcggccgcttactttttcaagtaaatccctttgtttaagggactgcaaagatagaaactttttctttatttacaatactttccaacgattttacgcactcaattccgctaacctttacagaatcagagacaaaaattttgaatctgtaacaggtactttgctatagatttttgaaagcatactcatcataaaccgtgttaatgagattatccgaattgatgtttcttgaaaaaattggataatgaaaacgatccagcttattaaggatacggatcagatccatcttttccttatgattgaggttacctgcaacgatattggttgcctggcggatcttttccatttgtttttccagaacaatcagtcctctttcagaaatacggattaatttacttcgtttatccagatcagagtctgtctgttcaataagtccctggcgcaacagtcttgcaataataagcataccgaccggcttatcatgaatattttttttgataagtgccatcttggtcatctcaccaaaagcctttaaattaattaaataaataaaatcttcctgggttgaaaattcagagtctgatattgcggatttggaataggttttcgcgtagcggttaaggtgaaccaataatgtacttattgcgctttccggtgttcttccattctctttgccctcccaatagggttcttcaaaagaatctgcatgttgcgtattctcctgatcagaaatccaggatttaaaaccttcaatagtacagggataggaattaggatcagcatctgattcaaattgctcaaggagcgtcataaagtctttgataagggcaaaattcatttcaataaaaatagtatacaaatatactttattttaggtaaatttcctctattttttattccatacggtacaacatttgcagtttaaagtttaattatcaacgatatgaacgaaataaaaacagacaggttagacccggttacggataaacatctgattgatgaatattttaacctggcagtaaaaaaggaattaaatatcgacattgacgttagttccgaatacattgctgcacataatatcgtttcaaaaaaatcaattctcgttaaaacattttcggatgccgttatgggaaaccctgatctttatcttttacttcgttcgttaattcaaaatgtaaacacttattctttaacaaaaagccagattatcagtacactgaagaaataaaaagaatctctcaaaacttatgagagattcttttttggtaaattgaacttcgttatacctgttctgtgatatgctttgccaccattgcctcaagatcatccagattaaatggttttgaaacataatcatccgcctgtgcttcagaagctaaagcagcaatatcattatttgccgtaacataaatgaccggaatgtgattaaattcttcactgtttttaagaagctttgtagcctctaccccaccgatgcggggaatccagttatccataagaataatatccggctgatattctgctactttctcaaggatgtcatgagatgtttctgaaattttaacatcatagccattttcttcaaatatgatggtgatgacttctaaaatagcagtatcatcatcaaaaattaaaattctctttttattcatattattgaggttattctattacaactgattgatataatccgctaaattatcaggcctgataattaaatcataatcaatttcttctaccgcatgtctgggcatatattccacttctgcagtttcaggatcctgaatccacacctgcccgttatactttttaatataagacagaccttctactccatcagcattggctcccgataaaagtattccaaccatatgttctccgtaaatttccgctgcagacctgaaagtaacatctatggaaggcctggaataattcatcttttcagagctgtccagtgacatatttttcttattttcaaacagtaaatggtaatcagcaggaacaatgtacagggtacggttattaatttcggttttatcttctatttccaccaccggtattctgataaactgctgcagcaaagtccgcaggatatctccggattgggctttacggtgaacgaccactacaatcggaatattcaggttgtcatcaagatttttgatcatttcgatgatgacctgtaagcttcctgccgatccgccaataacaattaattcaatattcgtctctgatttcatgattgcattattaatggtgatcaagctttttccagattttctggtcttcagtctgatgataattcttttcaatggtagaaaaccgaagtgtttcttttgccccgagagcaagaaaaccaagattttcaaggctgttgtcaaaaagtctgaacaccctttcctgaagttctctgtcaaaatagatcaaaacatttctgcagataatcagctgaaaactgttaaaagaactgtctgaaaccagattgtgagtagataaaataagcttttcctgtaaacttttatcaaacttcacactatcataattagcggtataataatcagaaaaatcccttatcccgcctgaaagcatatagttttcagaatataatttcatctgatgcagcggaaagactccggctcttgcggtctcaagaacagcaggattcaaatcagtaccataaatcagcgatttatcatacaagccggcttctttcagcagaattgctatcgaataggcttcttcccctgttgaacaacctgctatccagattcttatcaacggataagtacctaattgcggcagcactttttctcttaatgctttgaaaaaaggaggatctctgaacatttcggtaacgtttaccgtaacttcttctataaaacgtttcagatactccggatcgttcatgataatatatctgagctctgcaaaactggtgagcctgtccaaaagacatattctgtttacccttcttttgaacgacgctctgctgtagccggaaaaatcatatccgtacatctcatatacatcgttgatcagatactcaacttcctgatcttttatgatacttggttccagcatgtattacaacttttctattgcttttattagaagatccacatctatcggttttgaaacataatcatccgctccggcttccatacatttctgacggtcttcaggcattgcctgtgcagtaacagcaataacaggaatatctttgatttcaggggtatctcttatgattctaacggcttcgtagccatctattccaggcatcatcatatccataagaacaacagaaaactgagggtctgatttcaggatatcaaaagcttcctgagccattgtacaggtttcaacagcatatccacgggccttcagggtcagtttcaatgcaaatatattacgtggatcatcatccacaattaaaattttcttactcatcagaactatatctgtttaactttcatataaccaaacgcgaaggagcgataataactgatcaatatctacaggttttgagatataatccgaagctccggcggtaatgcatttttcacgttctccaatcattgatttcgccgttatagctataataggcagtcttttaaatgccggcatttttctgatctgctttatggtttcataaccatccatttcaggcatcatcatatccattaagataacatcaacatcaggatggtgattgatctgctcaagggcatgttttccatccatcgctacaatcacatccaccttgtatttttccagtgccttggttaaagaaaaaatattgcggacatcatcatcagtaatcagtacttttttaccacttaacacttccgtcagagaacccagcattcttcccgtattgttttctgctgaattgtttttttcttccaccagatgcaggaacagcccaacttcatccagaattctctggtacgaatgtgctgtttttactacaattgaatctgcatactgttttattttaagttcttcttctttagaaaggtgatgctctgtgaagataatgatcggaagattttcaagtccttcatggcttttgatggattctattacgtggtagtcatttccttttgaacttccaatgtccagaataacgcagtcaacaagatctgaagtcagtgttttcacactatcttccacagtatgttctactgataatgagatattaaaattgctcaggaagtaagataatgcgctggcatgcttggcattttcttctacaataaggactttctgagatccttttttcaatgcttcttcaatttttctgaatacatcagtcattttatccagggcaaccggcttattgataaagtccactgcacctttcatcagactttcctttttgagatgaagaacagacatcatatgcacgggaatatgttttatatcggcggcagacttcagttcatccattacctcccagccatcttttacaggaagctgtacatccagcaaaatagcatgaggacggtatttctgagctgcagaaagtgcatggtctccccttactacaacaatacctttataatgctgtaaatgtgcgtatttcaataaagcttttgcaaagttgatgtcatcttcaatgatgagaataactttatccccttcttgaatattttctctgtcatctgccacatcttcaggaatttcaagtgtattaagaggagtcacttttatttcgccttcatccaggatattctgaatttcttcaacatcttcacgaatgacctctacaatatcctgatctgtttcggaatgagtaatttctgtaacagcatgtacaggaatgataaagctgaattcactgcctttgtctacttcgcttttcagaacaagttcacctccaagaagtctggcaatttcacggctaattgacaaacctaagcctgtacccccgaatttgcgtttggtagagccgtcggcctgctggaaggcttcaaagataattttttgcttatcctctgcaatcccgacacctgtatctttaactgaaaatataataaaatccggtttttcagtgtgttttctgatatgcaggtcaatgcttcctttcgtagtaaattttaatgcgttggataatagatttctcaacacctgatcaattctaagacggtcgctttcaatcaccttctgtacatcttcatcaatcacaatgttaaacggcaatgctttttcctgaaatacaggattgaataaactctttaaatcttttactacttcttcaatgatgaccttctgatattccagggtcatttttccggattctatttttgcaagatccagaatctcgtcaataagtgttaataaactcgatcctgaactatggataactcttgcagattctacctggtcttcattgagattctcatccggattttccgtcattaaacgtgataaaagaagaatggagttcagaggagtgcgcaattcatgagacatgttggccaagaattctgacttgtatttggtacttaatgccagttcctctacttttttctgaatctcattgttacgttctgcaatcagatgatttttttcttccagcaatctggaacgctcttcaagttccgcgttagcctgcatcagttcttcctgctgcaccttaagttcttcttccgaagcctgaagtttctgtgtttgagcctccaattcggtattcaggttttccagctcagaatgctgaacctgcagttcttcagactgtgcttgagtttcttccagcaactgctgttctttttccctgctttttgcagcgctgagggcaattcctatattaacgcagcagtcctcaaaataactcactctgtcttcatcaaaattagaagttgagccaagctccaagactccgataatatgaccatctgcaaaaagcgggatcagcatgattccgtaaattttaattgtactgctggcaaaggttaccacgaagtcatcttcatgaaggttattgtaaacctgtgttttagcactaacaaaagtttgtcctaccatcccttcgccaggctcaaaagctcttttcatattggattccagtccgaatgccttgttaagctttaaaataccttcatcatacagatacaatgaaccgttgatacagttcccatattcaatcagctgcatcaacgccttattggaaacttcctgaaccgatttggttcctaccagagattcattcagtaacgcaagacctttctggcgccagtcgctcttattaatcttctcaaaagagattttgagggattctgtcatatggttgagagattctacaagatctccgagatcatcctgagcattatctactgcccgttcactgtaatcaccgttagctaccctgttcgcaattttctgaatagcacttacacggcgtgtcatttcttcatctttttctttaagcattctttccagcttatccctgcggataagatctgcacgcatcttcagataaaaaaacgtggttaccacaatggcagcaatggccgaaaaaattataaagagaacggttgtccctgaggagcggttaagatctttatttttaatttcaagctgactttcttcatattgtacaaaatcattgacaatcttacggcactgatccatatatgccttcccgtccgtaatttgctgctgggtcataatgatgccctttcgtctgttttcaaccagttgcttcagattccccatcaccttgtcaactgcaatctttaatcctgcaagtctttctgattgattctggtcatctatacccaaagattcagcacgtatcagggcgtttggatattctctcaatccccgtttataaggttcaagaaaatcttctctaccggtaagctgataccctctgtttcctgtttctgcatccagtaaagcaaccagcacatctttaactgctgttacggaacgcctgcttttagaaaggctttcacggtgattcatctgattccggatactccaataggaagccagtgagctggctatcaaaatcaaaagcgaaagacctactccaaactggagatttcgtataatttttttcggcattaaaattaatttagtggtaatgtgaaataaaaggtagaaccttctcctacgatactggaaaccccaacgcttccatgatgctgtttgatgatctcggagcagataaataatccgatccccattccctgaaactgcagtgaagattcttccacgcgatagaattttttgaatacagcatcctgtttaaaatccgggataccgattccaaagtcggttacattaactcttacttcttccgcttcttcatctacaaaagtggtaacaataacctggttattatgaggcgaatatttaatggcattggtcagaaaattgatcagtacctgttctatacggatttcatccagaggaattaaaatatccggtttggttccgtggcgttcaatttttacctgacgctggtcatgagtctgcaatatggtttcaatagcattactgatgacactttcaagattaaccggttttttattgattttcagttttccgttttctattttagaaacatccagcagatcggtaataagcgtattcagtttctcaatctgcccctgcactttcgttacaaatcctgcttcagagctttctttatcaagctttagttttctttccagtaattgtacataggctttaatgcttgtcagaggagtcttcagctcatggcttgcaatgcttaagaattcatctttttctttttcaactttcttctgatcatcaatatccgtaaaggttcccacccattttttaatgcggttttcatcataaaccggagttattctgagcagatgataacggtaatgaccggaaatgacattcttaattctgacttccatttcgagggcttttccctttttccggcatctcgccagttcttcctttatattcagatcatcaggatgcgtttcgggaaaatccagttcggaatcggaatactggtaccatttaccattaacgaaatccacagctccggattcattgagagtgaaggcaatctggggaagtgactcaagcattaagtgaaaatgatcaatctgtgacttcatggtgacctgagactctcttcttccttttacctccagctcaagattctgctgtgtctttttcatggcaatgttttgctcctgaaggttatagaaagtctttaccttaagcagaagaatttcaggatcaacaggtttggtcacataatctttagctccggaggcatatccgcgtgttataaagcgtttatctgtattgacagcagataagaatatgatggggacatcttttgttttgctgtaatcagcaagcgtttctgcaacttcaaaaccgtccatatccggcatttgaacatccaaaataattaaggcatagtcatttttcagggctttaccaagagcctcttcaccggaattggcagtttccacctgaaaatccttagattcaagtagtttttgcagtgagtaaaggttattttggttgtcatcaacaattaaaatcataaaaattaaaatcaataattagttacagctagtttagtttcaaaaatactcacaatatttgagaaaacagtaatttttaaaggtatttggaggtataatccataccacacttttcaaataaaatttcaatggcataaggattgaaatgttattactatttttaaaactttcttcataattttcagaaaaaaaacaagcctatgaaaaaaacgataagttgtatgaatatagatgagaaaattttgtattcattcggcggcgaacgggttacttataaacctaaagatttcattttccgggagggagagcattcacaatattatttccagatcataagcggaaaggtaaagctgaacaccttcaacgaaaatggaaaagaatttattctgaatattcttggtaaaaaccagagttttggtgacccattattgtttattgaaaagctttatcctacgaatgccgtcagtttacaagctactgaaattataagaatgcctaaaagtaacttcatggaaatgcttcagcagcatcctgatctttcccttgaaatgaatatatgcctctcccaaagattatactacaacagcctgatgatccataatatggcttcctcagatccttctcaacgtttaaaaggcttactggattaccttaaaagttatcatgacggagattgccaacactgtttccctatagagcttacccgccagcaaatggcagaccttacaggtttaagagtagaaacgatcatccgaactgtgaaaaagatggttaagaatgaagtgataaaactggacggacgtaaaattttgtactaatcaaacaaacgaaaaacactcaaatatagaatacaaataaaccacatttataataaatgaccagagcatcaagaactctggtcattcatcaaactaactttaatttgttttctttctccattctgccttcacatcttctgcagcatcttttgtcttttcccaggcttcatccgctttatctttaatgtcgtcccaggcatcagaaatattggatttcactctttccatccagtcttcctgtgttgcttcttcatcattatttcttttttcattgatataatctctggctttatctgccaggtcactgattttccattttgcatcggtagctgcattcttcagcgtattttccgtttcgtttactgcattttctgctttgttgtaatctgaattattcataatataatatttaagtatttggtatataaataaacaatgttcatgcctaaaaaacagacattatgttaaaatattcttaaaattaaaaatgataagaattttactttttctttccacttaggcttctgatcattccttggaagataactccatggaatggcagcaccataaaccaatacaatctgccccaaaggccttttggacgaaataccgctttttgccagattttatttctgtaaattttaaacatcagccaggcttctcccggcagcttcatctcagcgaataatataagctttccttcctgacggtcagcatataaaacccgccagaagtctaatgcatcaccatctctaagttctgaaggatgtcttcgtccccttctcaatcccggaccgccaacgagtttatcaaggaaccctcttattttccaaagatcctgtccgtaccagccatgatcacctcctaactgaaagacccggttcatgcaggcttccctgtcatcaaactcttcgctccggaggtcagtaaaacaaccgtatttcggtacatcatggtattctttcaatgttgaatcattacggctgctgatgaaactgtctttccagctggaaataatctcattggcctgaatttttgcaaatgttcttttcaatgctgtatcataggaaaacggctgcacaccggtaattaatttgatttcagcaagactttcgggacggcagaccacttctactttcatgcttccaaccaatgctttagccaggttataagaggttgaagtaataaaatagagccagtatgaagagagtctgggcgtcattacagggagtgtaaaaattgttcttttcaggcctcttacttttgcaaactgcaggagcatgtctttataagtcaatacatcatcacagccaatgtcaaaatttttctgataagcagcttctttaaacaaaacgaaaatcaggaaatccagaacattcgcaatccctatcggctgacattgggtatagagccatttgggagctaccatgacaggcagcttttcaacgagatcccttatgatttcaaatgatgcgcttcctgaaccaatgataattcctgcacgaagaactgttgcgggaactctgcaattcatcagaattttttcaacttcgtatcttgaattcagatgctttgacagttctttttcattcaccaagcctgagagatatacaatatgtttacattgcgttttctcaatgtaagcggaaaagttggcggcacatttcttctctgagtcttcataatcagcagtattgctcatggaatgcatcagataataagcccctgcaatatcttcgggaatatttttaagcgtttccggcttcagaaaatcaacttcaataacttcaatgagttgttcatcgatatccatgtctcttgtaaaacggcctatgtccctgcagcagcaaacgactttatatccctgcgcagcaatcacgctgatcattcttttaccgatatagccggtagctcctgtaagcagtattttttccataattattggatttaacagatcaatacatatgctgcctgtctgaagttcgttatattttttctaaaaaatgaccaaaatagtctttctttttaacaagatagcctgcattaatctcattggaatcaatttccaaaggaatcctgcttttgagaatgatactgctgttctcaacagatttaaccttgtcaggattgttggttaaaagattaatttccttcacatgaagcaggttcagcatttccactgccgcatcaaagtttcttccgtctgccggcagacccagcctgagattagcttcaacagtgtctaacccctgctcctgaagcgcatatgctctcagcttattgatgatcccaatatttcttccctcctggcggagataaatgatcattcccccattttcagacatatatttcatggctgcatcaagttgctgaccgcattcgcattttttagaatgaaaaacttccccggtaatacactccgaatgaaaacggacattgacagttttattacaatctgtattttctgctaccagaaccaaatgcgggctccagtctttttcattttccgaaaacgcatatacggtaaatgttccgtaatctgtaggtatttttgattgtgcctgtatggtaagcataggtttcgattttaatttaaggttgagaatctatttgtcaaaaggatttttcttatcctgttttacccagatgagttcagaggtatcatatccgatttcctttgctttggaaataaagtcctgttttatattttcaggaattgttttttcacgggaaagaatccacagatactccaggttttttccggctactaaagcatatttgtaattttccagcgccactacattatatccggcatagaacggtccgaaaaagcttacctttaaggcagctgtatttttgtcacctctgaattttgctgtcccgttggccgacacccatttttcctttttggtattatacccgctgttgacgacattaacacttccatctttattaagactatactgagccatagcattgtcgagatctttttcaaaacgataatcaaatctggcaatttcataccatgtacccaaatatttattgacatcaaactgattcacaggttgtgctttttctggcatagaagaacatgatgagactatgaatatccataatccacaggcagcaataagtttaagaattaagttatttttcatttttagtaatttttttaaagaaataaatattcaacagaaactggctgtaaccatatacagcatcttctatgggaatggtgcccattctgattcctaaaaattcttcgggattataattaacaaccggtgatggaattaaagatcctgtcaggattccattcacagcaaaaaatccaggcattaaaatcagatagaccagactggcttttcctatccactcttttttagcaataaaatgaaggtagcataacgtgaagattgtaacaattacggtgagcaaagtatatattctgtcacaatacagaaaacccgttaccgcgagcgcaataactgatgtaaatacgatgagattattaaacatgtcagcccagtccatattaaaaaacttttcaaagcagtaataggtaaaaacacaggcgaagggaatacaataaaaaaacagccattcttcaacaggaagccctgcaattttaaatcctaaggtgtacctgagatcaaaccaccacactcctttaccggtaaaccatatatcccagataataaaaggaaccgccacaatggtagatgatatcagaaacttcccgaaaagcctgttaaactgtatccttccgtcaaaagaagccagaaagcagataataactgtaaaaaaattaatcagtatgtaagtgtagggcatcattttttatcgaaatacattttaaaatattgaacaggcacccataaaaagccgaagcattctcctttttcttttcccagatgcttatgatgctgtttgtgggcacgtcttatcgcaagcaaataaggatttttggttttggtaaaaatctttgctctctgatggataaaaatatcatgtacaaagaaataggccattccgtaaagacttattccgaggccaatataaaaccaataactgaattcctgctttacccccagatataataaagctatggccggacttgcaaaaatgaaaaagaaaaggtcatttctttcaagttttccttcattgctgtggtcatgatggtcacggtggagcacccacaggaaaccatgcataatatatcgatggatgagccatgtagcaccttccatgccaataaaaacacccaaaacgatcagaaaattcattgttaattatttttgctgttaaaacgatcattcagaattctgtatctgaaatcaaatatgctgttcagtttttcttttatgaacaagctatgagcgatccgacctagaaaacccaacggaagctcataatctactgtatctttcatcaatactcctttttcattgggaataaattcgtgaaaatgattccagtatttataaggtcctgattcctggaaatcagtaaaacttttaagttcatctacctgtgtgatgatggttttccatctcatgggaatccccagcaaaggagaaacacgataattgatctccattcctttgaaaacaggcttatccttaacatctgacagcacaacaaaattcatacttgccggggttatttcagataaattatgaggggatgaaaaaaacttccaggcggtttcaatggtacagttcaactgctgttctctgtataatctgtatttcattacttattttttattctagattttccaatgaattaattaccatttttaccatcacagataggcagatttatatcttatatagcttttgaatgctaccagcagcttctgtgaattcgcaatcctgatcctgttctgtaaaatgtgatgagaactggctttctttattttttcaaacaatgacaggtagtatttataagccagataaacaccaaacattgaagagccgggcagttttttaatcccttgtaatgcttctctgaactcttcgtcaatttctttttcaatccggactttcacatcattatcgaaaacagacatgtttaaagctgggaaatacgtccgtcccaatatctggtaatcatctttgagatcccgtaaaaaattaactttctgaaaagcggaaccaagcttcattgcatatggtttaagctcttcaaactgttgtttatttcctccggtaaatatttgcaggcacataagtccgacaacttctgctgagccgtagatatactcattatacaaagcagaattgtaatctattttttgcaggtccatttccatactgtgcaaaaactgattgataagctggatatcaattttgtactgacgaaccgtttcctgaaatgaatgcagaatgggattgatcgatataccgtcttccagcgcgctgtaggtttcagcttttaacctagttaagagtttttctttatcataaccatgaaaactgtctacaatttcatccgcaagccgtacgtaaccataaatggcataaatggcgggtcttatggaaggttttaatgccaatatccctaatgaaaaactggtactgtatttccgggtagtatatttgctcacctcgcaagacaactcatcaaacaattttttcatattaattaagttttagtttactgacttcagatgctacaattttaccggaaataactgatggcggtactcccggcccgggaacagtgagctgccccgtataaaaaaggttcatgatctttttattcctgatttttggcttcagcactgctgtttgggataaagtgttagataatccgtacgcattgccctgataggcattataatctgaaataaaatcacttacacaataactttttttgtattcaatccttgaaataaggtgactttcgcctgtatgtttttctattctttcgagcatttccatcaggtatttttccctcaccggttcttcatcatgaattcccggagccaaaggcaacaacagaaaaagattctcgcagtcttcaggtgctacgcccggatctgtttttgaaggacaacaagaataaaaaagaggttttgcaggccattttttatttttataaatgcagtctatatgattatccagctcattttcaaagaaaagtgtatggtgttttaagtgaggaattttacctttaattccgagataatatataagacatgaaggcgcaaaggttttggattcccagtaagcattcttgtaattccgaagggatttgggaatcagggtttccgtatgatggtaatctgatgaggcaatgacggcgtcaaattcataatctttatcatttaccctgattgaggttaccttcccgtcttctgtattaattttctgaacatcatgattaaaataaaacacaactccttgtttttctgccaccttctgcatcgccagaacaagctgatagaagcctcccatgggatatttcgttcccaagacatatccaccataattcataaggctgtatagcgccggtatattctggggagaagctccgaggaagatgacaggaaactccattaatgaccttagtttttcatcagaaaaatatccggatacatattttcggaaattactgagaagatccagttttacagcacttccagctatttttaaagaagcgaattccagccagctgtagcagggtttggtaacaaattctttcattcccacttcatatttatattttgcagattccatgaatttgtcatactgcttacctgctccgttctcaatcttttcaaacagggctcttatttcatcattctttctgggaacacagatcttttcgcctgaaaaaaccatttcaaattgaggatccaaagccacaagtttaaaaaaatcatctgccttcatattaaaatccctgaaaaaatcttcaataatatcaggcatccaataccagctgggacccatatcaaaaacatatccttcttcagttgtaaactgtcttgcgcggccaccgggctgatcgtgcttttcaaatacatgtacttcatttccggatttagcggcataagcagctgctgaaagcccggaaaaaccagaacctataacagctattctttttctcaaattttccttattcattgttattgatttatcagttgggacaatccggcttaattcagttttttataggctatatccagcagatccattgcttcaagattcattttgtatacagcatggtgaaattcatctaatttggaaagtatggcgatgagcagcattttctcggaatgattgagatttccggtgaccatttttgaggctttacggatttcatccatatgctgatccagcatcttaaggccttcttcagttatctgaatatgtttggctcttttatctttttctgaaacagtctgttctatccagccattcttaagtaaacggttaatgatgagtattcctgcaggtttttcatgaacattatgtcttatgagttccatttttgacatggctcccatagatttcaggctgatcagataaatgaaatcatcctggctggaaaatcctgaattattaatggcagacttagaataagactttgcatacctgctcattcttatcaacaaagtattgattacgctttcttcacttcgtcccatttctttacctatccatccgggctcctctgagagataatgttctttatgggaagattcgatccattctataaaaccctgaagattgttgctgtaaatagctttttcttcattttcatcagcgaattgcttaataagttccacaactgcttttataagatcataattcatatcaaacaaattagtatacaaatatacttataaaaacataataagtatataaataaactatatggattaaaaaacaaacacacaactcattgatttacagcgtatttatttttaaattaaaagttgttaattaagaaatatgatatatttataaactttacagggatgtttaaataaaacctggatttggtaagctatcggtctgctttgattttcagaccataagaaagctgaagaatagtatggtgattatgatcttaaataactgttactatgatcattaattaaccttaaaatatttttttaatttaaattcgtattactttgtgtaatggaaagccaaacggaatggatattaaaattctataatagaaaattatgtaacagtaaatatgagtatcactttttataaaccgaaatcagatctgttaagccggtatattgaaggcttttattttatttctgagcatgatacgttaaaatcaaatcaatattggacatttcccagtaatttctgccttgcaacgatttgtcaggacacagagttaattcctgaagaaaacaaaatcacaataagaagatcaatccataaaagagtgcattcatttctcttttacaacatttccaggccaattaacgttacttacgaagagcctagaaatgaactgacgatatatttcaaacctcttgctatttttcatttctttcctaaagtgtctttttcatcagctgcagaccattttgagaatttcaatccttaccctgattaccaatctaacattcaggatctgttgaaaatgaataacaaagatgaacaggcacatgtgttagaaaaatatcttctctccaaactttataatccgaagcttgaaacgatgcaaaacattctgcaaaaagttgaagaaggatggaaattaaatgacattgctgaatctatgggtatgtccaggcaatatcttcacagaacatttttaaaatacatgggaaagtctccctctctgtataaaagaatacaccgcttcagacagattacttcttctctgcaaacgaatgaaaaattcatttcattatcgcacgagaatttattttttgaccagcctcattttaacagggaattcaaagcgttaacaggtgtggttcctaccttatttttcaaaaacattaatgattcaaaagatatgctctggctttttgtttagtggtttacattcatacaatgttcagggtattggtatttataattttgtacatgaacaatagacaagagatgatcagattactttttattctttggggaacattagcttttggacaatcggttaacctgtccgtcataaggaaacaactgcgtattcttgagaaggagaattactttagcggtgttgttttgattgccaaaggtgagaaaacgatctataagcacgcttttgggtatgctaatatggccgacaaaattcccaataaagcagataccaaatttaatttggcttctatgaataaaatgtttacaggattagccattatgcaattagccgaaaagggaaagatttcgctaaatgacagagttggtcaatatttacccgaattccccaataaactcgtagccgattccgttaccattcatcaattattgacacatacttcaggaatgggaaacttttgggccgaacatgacaaactagcgaaagaaaaatttaaaacggtaagtgattatttgccgctttacgtgcatcaggaattactattctctcccgggaagggttttcaatacagtaattcgggatacatggttttaggactgatcattgaaaaagtttccggattaaattatttcgattatgtaagaacttacattttcgaacccgcaaaaatgaaggatacagattcttatgatctggaagaagcaatcccgaatatggcaacaggatatacaatgctatcagaaaaaccaggacaatggaaaaacaatatgtatagtaacgtagtcaaaggcacgccagcaggtggagggtactcaacagctgaggaccttctgagattttctctggctcttcagcaaaacacgatacttgggaaagaatttacaaagctgtattccattggtaaagtgcaatataaagaaggttcttacgcttatggtatcgttgagagctttttaaatggtcaaagaatgcttggacatacaggcggacatttcggaatagcaaacgaactgatgattttcccggaatccggctataccgttgtaattttaacaaacggagaagttgaaaattattgggaagtttccaatctcattaaaaagcaattaaccggaagtacaaatgcaacagataactttttctatacaaaagatcttatccggacagtggaaaaaagtggtctttctgccggaataaaaaaactagaagccgattccaacaaaaaatatatccttaaggagaatttaatagaaaggtatgggcaaaagtttctcttcgaaaaaaagtatactcaggcaattgatctgtttcaactgtctgcgactcagtttcctgattctgccacaccttattacaacctaagtgaagcttacagattagctcatcaaaaggaaaaagctattgaagctttgaaaatctatttaaagagagaaccgctggataaggaagctgaaattaagtatgaaaatttaaaaagcagtaaatagtaattaaggatagtcttactatttttcccaatgctgccactaaggacaaaaacaatcatattcatccataaaaaaaagagacaactttaatagttgtctctttcagtgacccggctgggattcgaacccaggacccatacattaaaagtgtattgctctaccagctgagctaccgagtcggccacttattttttaagtaaatccctttgtttaagggactgcaaagataggaaaacccacgttaaatccaaactttccggcgcttttttataataaattttaagtcaaaaaagtcaaacacctgtttataaatcaattacactatttatttttttattgaattttttcagcaataatcatagttgacagataaactgccatttttgggtaaaaaattgtttggaagaataaaaaacaaattatatcttagcaactaagataattacaaaataagtaaattaatgacaaaatataatattcaaaatttcagagaggccagcagagcctattctgatgccagtatttttatgcacgaggccattgccagaaaagcggggctttccagtaccgatcataaatacctgggccttattctacagtatgaatcggttaccgccggcgaaatttctaagttcacgggccttacaaccggtgctgtaacaggcttgatagatcgtctggagaaaaagaaccttctgaaaagacagtttattcaggaagaccgaagaaaagtgatcattatcccaaatgttgagaacagcatgaaattactgggccccattttcgatgaactgcagcaaaaaacacttcgcttaatttccaccttttcaaaaaaagaagtagaaaccattgagcgctatttcagggaagcaacaattcttatgaaagaaacagcagaccatttaaataaccaataaaaactataaaaccatggaaaacttagccacaacttatctaacgcgcgcagaaatatggctttgcattacgaccttactctattttcttatgaatggcgcacagatttttgagacgcttatttttgttcccaaatgggcctcttccccacccgagacattcaggtttcttcaggatggaaaaggggcaagcctgaagtttttctggattatactccactcattgcatgaaatagcttttattcttgctattattttctgctggaaaataggtccggtaaggaactggcttttagtattatttatcattcatgccgctgtaagagtatggacacttactttttttgcgcccaatatcatccagtttcagaatctggcttcagcttcttcggttccggaacaaatcttaacaaaaatatcgctttggaaaacgcttaactatattcgggtagcagtttatattgcggtttcaataggctttattcctctctgcattaaacttttcgggcttcgccagtgatgaactggccacagtgtttaaaatataaaaaaaagagactgccttatcagacagtctcagcactctactataaaatcagctgataagctatacttttcattaaaacttttccctacgcaggtgaaagtcgacgtgacttcagataaagggcagtacggttcaggtaaggaaaaagaaaaatcaataacagtgacgcagcaagaagccacaccatcatttcataataatccattgcaaaacggacatgatcctgaacattcatccttccaatcaacagcttattggccgcttttacggctttaccttcaggcattcctctcgcaacaagtttagcggtctgctgatgaagaaaatttttaacagccggatccacagcacttaaatgatcctgaaatgcattataatggcggcttttttcaaacagttcaaaaaaattgatcagtgcaatgctgatacaaaatccaagataccgtactgccagggctgttgcagcagctgaggggccaatggcagcaggaactgaggagataataaaaataatcgtcgggaccataatcaatccaacacccaatccctgaatgaataatggaatataataattaaactcatcagcctgaacatcaaaagagtaatacattaatccatggaaaataagaagcattaaaaatccgggaccccagatatatcttatatttttcttctgtaaaaccatacagcaggcgataatcacacctgtaaccaatcctgcaagattgaagatattgatataggaaatatgaagcggatccagatgcagctcagatgaaaaatagctattgacaattcctgatgcaaaccggcagatatacatcacaaaaaggatcagcagacctaccttaaaatttctgtacctgaaaacacgcagatcaatataaggtcttttgatagcctgctgacgaaatacggatatcaatgccagaacagcaattccaatgatacttcccataatccgcctgtcttccagccaataatattcctgtccgaaaatagtaatatacccaatcagcaccagcatcgtactgaacagcccaaaactttgccagtcaagcttgtacagatgaaaccttgcatgcgttctgtaattgctcatggccagtgcaagaaagataagtcccggaaggtatgagaatatggctgtcttataaacgatattaaaattataggaatcaataagatctgctgtgatcagattattaaagggcaaagcgcagatcagaatcccgaagaatactgaaaagctgatctcccgccctctttcactgctcagccttgtaaaaatgagcgtcaatgaaaggtttacgtttcctgcaaacaacattccctgcatgaagcgtatcggaaacagtatatagatttcacgtgtacaatagcataccaggcaggccaatatttgcagcgtggtaaaaagcagaaaatattctttcgcagccaggaaactgaaaaatcttctttcaaggctgtaaaagcctacatatccggcatagaacagtgcgactgaaaactggatatctgccggctcacttccgtaatatccggccgctgcattcacattcgcaagcgggagaaaaaagataatgatccccggcagtgtcattgaaaaaaggatgattttaacaagccattcaggagcccattttttaaaataaggcatctgtcttttagccattggaatgttttttattggcatatacatttacattcattcctactttcagaatatcaatgtcttttctttgcccatccaccctgattcttacaggaatacgctgcacaattttcacgtaattcccggtggagttatccggcggaagcaatgagaagcttgaacctgttgccggggaaagtgaaataatcgtccctttaaactctctgtcaggataagagtctgctacaatttttacatgatctccgatgtgcatgtccttgatctgcgtttctttataattggccactacccatttgtcggtttcattattaactataaatgcaagtgtttctcctgcatcaatcatctgccctacttcaacggttcttcttcccatccttccgtcatatgctgcagtaacggctgtatagctcacatccaacttgtggcggtccagcaacgcttccaatctggcaatttctgccaggacaaccgttttttccgcccggatatcatttattttagacattgaagctgcataattatcctgtgaggatctgtaatcactttcattaatgtcaagagttgcttttacatcttcaagacgctgtctggtggcagattcttcatcatacagttttttgtacctgttataatcaagtttttgtttccaaacctttgctttattggcatctacctgatccattgctgcggcagcttctttttctgtagtttctgtagtactttccaggactttcaattgcgcgtaggctttacggagggctgcctgcgtttgtttttcctgaaggacatattcacggttatcaataattaaaagggtatctccttttttcacttcctgattttcctcaaattttacagcgacaataaatcctccggctcttgaaataatcgggtttacatattcctgaacctgagcatcattggtctgttcatatgcataatagttctttaaggtgaaaccgccccagacagcaagtgcagcaacgatagcaagtgaaatccatcctgtgatcttcgtgatcagtctgtccgttggagtatatttttttttcattgtattataaaacgcctgtaatattttgtagtaaataataattgttctgtgccataatctttgccgcttccagttcaaattttgtctgaagaagctgtatatctgcatccagcagttctgtaataagggaagtctggctgaagtaagtatttttgatgattcttgcattttcctttgcctgagctacattggcttctgccactttgatctgttccagagcttcctgatatctcagataggcttcctttacctgctgtcttactttatcctctgtatctttatgtgcctcttcttctttttcaaactccagctgtgccgcctttaccttttgcgtattatgatacagggaagagatggaaaacgaagcttttattcccactattcccaacgaataccaatatggattgtaaggatacaggaaaatctgtggattggcgtaatagaattctccatacatcccgactttaggtcttacattggcttttacctgcttcagtttaattacacttaatgcggtctgctgctcagaaacgtggtagtcaaaagaatgatccagcgccattttcaaatactcattataagaagtattcgcattccactgatcagatggtgcttcaggaataacaatctggtcatctggaattcccagaataatattcagcttttgtgtagcgataaggatatcattttctatagtgaccaacgccattttcctttttgaaagctcaagttcaatccttaaaacatcactttttaaaaccactccgtttttataaagcgactgtatttctttcagctgggttttctgatcttcaatatcctgcttaataagatctctgaagattaatgttttctgcaactccagataaagtgcagctgttttataatgaatatcagaaaccgactgctctttcaggatgtccttaattttctgaagggtttggttttccttaattttcagattcagcttgttcccgttgtaaatattcaggtaaaaatccgctccggctctgtacagcgtgtggatgacttcatgctgtgcaggtttcgaaaaaatcccgttttcatagatgggaatgttggaggctttttctgctgaacctttgatttctatttccggaaggcgctcttttttagcatcttttacttcggcttcggcaatgtctgcattgatggtattgattctgatatgacggctgttttcttcagctctctgccatgcgtcttttaaggagagtcgaatggtatcccttgttgaactgcctgtctgagccgatatggtataggaaactcccagcatcagcagtccggcgacataaattttcatttgaatttttgaattattgcactgcaaatttattggcaatccggagattatttttatctaaaatagtcaacttttacatgattccggccaaatgattatatttgcgttttcattgatattttaattttttatgggattaattgctgcgcttccggatattgataaagacgataaaagtgtatttgtcatgcatgagaaatcggaaaagctgattccttttcataagcataccaaaggacagctgagttatgtggaagggggtatcgcttacattaccattgataacaaaacctatgtggtaccggccaggcatttcttctggattccgcaaggaatggaacatattttggaaatcggacacactgcaacggtcttgcgttctctttatttttatgctcatgatgatgtttcagatcctttttacagcagactgggaatttatccggcctctgaactgctgatccagatgataaaatatactgaaatatgggatgaaaaacatgttactgcaaaagatgaaaactttgaatttcttgtggcattaaaaaaaatccttcccaaaacccatcagcagccattacctattattcttccggctactcaccataaacagatgatgaaaattgtatcttatctggaatggaatatcggggaaagacttactctggcccatgtaagcagcaagttcggtttgagtgaacgttctttgtcccggctgttcaaagcggatatggatatttctttcctgcagtacctgaaaaccttaagaattgtcaaggctattgaactccttttaaatacggacaagcccatcaatgaaatagcagacgatgtcggttacagctctatcagtgctttcagcgatacttttcatgaattcacccagtccagaccttcggatttaaggaagagcaataaagccattcagaaccttacagattaaattgattctgaatgaaataaaaagcctttaaactgattgtttaaaggcttttctctatcattactgtgtcactttcattatcgcattggtaatctcaatttctttttttcctgaataagcggaatcaaaaggttccataacattgaataaatactgataaaaaggagcaatctgacggacattttcggattccttcactgctttttctttccccatctgctgaagtccctctataaaaacattgaattttttgtcaatgggctccatcgattttaaaaggtatgcatgcgctttttcattttgtcccaagcttttataagcgtcagtaacggctgaaacaacgagtgcatattccatcggctttgacctcatctgtctttttgccatcgctttaaatgatggtgagagactttgatagtaatcatattcttcaaatatcccattcttaagtatttcggccagctgaagtcctttctgttcctgtcctgcaacaatatatccggtaacaatggcactcaatgaacgtgggtcattgtatttctccacaggaatttcttttgccgcaagatccagtaattccagcgcctcagttttctgtccgcttaccataagtgctgatactgctctgctcaccgacactctgtagcccagaatatttgacgttgctgtttcatcataataattactccgatctttaaaatttccccatctgaaatttttgaccacatgataaagagaattggcatctacccctcctctatctccaccggatccctgaggagtacggataggcaccagtctgtagctgaaaccatcaaactgcagatattcatcgagataaaaaatattttcactttcatacattccgcctgatgaaaagtttatcgggcgcttccagtcaaaattcgcgagcatatccagcatcatcaggttacttttgtaaagggtattcgcttcataattaatcacaatctgatctgctgcattcggaatatcagcttgattaataatacctgcctttacagcattttccttgttcacaggcagaacaaatttactcaccggaagaatattatatttttcatattgcttttcaccaaagtacattttcagaagttcgtctttttcagatgatttcagtttcaggaatttaatagcatctcttaacgtcagagaatcctgtgtcaggtatttcctgaagtcctggaaagcggtttccggtgctccctgctctttcagcatctggaaaagcccttcccagtcttcttttttcatcagatacacctgatcattcactccgtctctatattcctcatgtgtcagttcacccggaattcccatagcattgtaggttcttcttttcacctggtcaatattccatggagtggctaaaagggtgaaattgactgttttcacatcatccctgaatctttctgtttcctgaatagcccacaccggaaaggtatcattatctccataaataaaaatgatatcatctttaggcagtgaacgtaacaatgaataggcataatcacgggctgctgtttttttgcttctgtcatgcgaagtataattctgaaatcccatcataaaaggaattccaagcaacacgactcccaaaacaatattggcagcattcgattttaccttggactgaatcagccaaaggattgctccggctcccagaccaatccagatggcaaaagcatagaaagaacctaccatggcgtaatctctttcccttacttcaaacggttttactccggtatagaagacaattcccacgctggtcaggataaacagcgaaagaatggcataaaatcttccaaaatcccttttaagatggaaaaagaaaccaatcaatcccagaatcaatggtaaaaagaaaaattttacagtactttcgttcttaaaccgggcaggcatatgatcctgatctccgagtaaagcattatcaataaaagaaaatcctgaaatccagtttccattggtgctttccatatggccctggagatcgttctgtcttccaacaaaattccacatcagatatctgacaaaataatatccgttctggaacgaaatgaaataatccatattctgtgcaaatgaagggcgctttaccttaatcagatcatagggttttactttcaggtagtcctctgcagtaatagagtctccttcatattttgctctcagttcatcaaaaatacgatgagcttcaggattgtctgctacctcttcgttatcataattgaaagtaaaatcaggagccccatacaaagaaacataattagccatcacttctttatcttcattgaacatccttggcataaagcttatgtgagatttattaaaaacataattgaatctttcccctgtttttctgtaggttccggttttttcatctttttcataaatgtctccggtgatctctcttttgtagcttccgtcttcatctttttccagtccgtttttatcgagaaatgcagtgtaattctgtccgtagatggtaggccagtctccatattgcaccctgttataataatctctcattccgatggctgtgtccggatcattaagattcattggcggattggcattagccctgatgggaatcaccagccagcatgaaaatccgataatcatataaaccagagacaaaatggctgtctggtacagctttttttttgtttttctcgcatatttaatcagcagataactcataactgtcataagaacaaacgctgcaattgtccctgaatggaaaggaagccctaaaccgttcacaaagaaaatttcaagctgtccaaacaaggtcataatcaaagggaaaataatcttgaacacgaaggcaagaattcccaaagtaaccagattggctatgataaaacttttccaggaaaaggtataatttcttgcataatataccaggcatatagccggaatagccagcatacacatcatatgtactcccacagaaagtcctatgatgaaaaaaataagaataatccatctttcgctgtcagcagctttagattcattctcccatttggtgatcagccaaactaacaatgcaataaacagagaagccattgcatacacctcaccttctactgctgaaaaccagaaggtatctgaaaaggtaaaacataaggccccgacaaccccggcaaaaaggatagagatttcctgatgttttgtaatatcttcaaaatctttatgtaaaagacgtcttaaaaaatgggtgatcgtccagaacagaaacagaatggtgaaggcactgaataaagccgacatcgcattgatcacaatggaataattttcggtattccccaatgcaaaaatactcgccacggctcccacaatctgaaataaagcagctcccggagcatgggttacctccagttttacagctgaagagatgtattcgccacaatcccaaaagctgagagaatgttcaatggttgaaaggtaagtaataagcgcaacagcgaaaaggaaccatcccagtacggtgttccattttttaaaagaccagtttttcatatcatattttccaatatgtatatgacaaccggggaaaagggtttattacatttactttattttattctaaaaccacaaaagtcaccaaaagtcttggtgtagttaattaagttgaaaaacaatgctgcaaaaagttcatataagaaaaagtaaatcaacgatttaaaataacttaagtatgctttaatactcaaaaacttttatgacttttgtggtttaaaatatgcatgtttattcaatagtaaaattttaataggtattattcaatcctccatccaaaggaatacttgttccggtaagataatttgcatattctgaagccagaaaagctaccagatgtccatattcttccggctgcccgaatcttttcatcggaattttattttcccttgccttttttatttcttcttcagaatttccggtttgctgggattcatgggcaacaagtttctgaattctttcagtatcaaaatatcctgtcaacacattatttaccgtaatattatgttgtgcaatttcattggaaagtgttttagcccaagcaatcactgcggaacggatagaattagataatgcgagatttccaattggttcttttactgaaagtgatgaaacattaatgatacgcccgtttttctgttggatcatgtgaggcaaagccagtaatgtagtttcacaaaccgttttaaaaagaagatcaaaagctttctgataatcatctgtgtttttatcaactgcaaggccgggttccggaccatttgtattattaacaaggatatctaccggatgttcattaaaatatcctccaattattttcttatagctttcaaaatccgaaaagtcagcaacaagatatgcatgtttctgaccggcattaataaccggaagagatgaaacaaaatctttaagtttagcttcattgcgagccataacggtaacattggccccgcattttgccagctctatggcgattcctgctcctattccctgagtggctcctcccactaaagcgttttttgaaaaaagttgaatattcataagatttttggatatcgtaattggtatagataaatgtaagaaaaaacctccagattatattttggaggtttatttttttaagctcagacccttatttattttacgactgtagcttccagttccacttttaaagtttcaaacaaacctttcacttcaagcattgttacggcctgctgaattttatgcccgccaatccattcctgaagaataggaaaatgaggccagagttcttccgtagaagtagtataaatatttaatcttacaataccgccgcattcataccctgctgtagtaatcacttcttccaggttggcaatagcctgttccagctgtgatttcatgtccttatcactggacgttccatcaggatcaatagctgcctgtcctgagcagtataaggtactttcaacatttttcacctccaccgcctgggagtaacttctttcatcctgccatttccatggattaactgttcttttttccattgtcttgaatttgttatttgttacggtacaaaattgcagaacaaatacagcagatccccgtgatccggatcacgattataatgtgagttcaatcacaatgttacaaaggcagacggctcagagtttctctggaaacccctaagtaggcagccaaaagagacttcggaacacgttgtacaagggaaggataattctttaaaagttgctcatagcgttctttaattcctgttgtcatcatggaaatggtacgctgctgagcagtgataaagcccatataggccttttcaaggaaaaaatgttccagctttgggagttgcccgcaaagttttctgtaatcttccagtttaatacaaagtacttctgtatcctccagacattccagagacattgttgccaaggtttgctgatagtaagccggaaaatctgtttcccaccagtcttccatggcaaaccctacaatatgttcttttccggtttcatcggtgtaaacaagttttaacagacctttcaatacaaaatagttgtaaggaaccgcttcccttcctgcactaaaaactgatgttttttatattttttataggtaaagcaggatgatatgaattcaaattcatcatcattaagaggaattattttttcaatatgggtcctaagctggtgcagcatattctctttattatggtaaaagtactcttttttcagtaagacatttaaattcgttcatatcaactcctatttctgtaagaacaggcaggataaagggaatcatcattattaaaaattatggcccgtcgttcagcagttcatcaatctgcttgtaaaatgaatctttactgtaatctgctaatcctttatgatgcagacggatttctccttttttatccaatacaacagttgtgggtaatgacccactgtaaagtactccgggaatattgccagctggtaccagaaaaggaaccgtaaagcctttctcttttaaataagattttcccagaccaacattatcatccagatttactgtaagaaatacaaagtccggatggtttctatatcggtcatataatttctgaacagacggaaactccgccctgcaaggaggacaccatgatgcccagaagttaatgaagattactttattttgtaaagcggaaacatcgatcatttttccatcttcatttttcagcataaagccattataagaagcgtggcttgaagtattctttatttcttttgcatctgatatgccggaatttaggattccggtggaagcaacctgcctcatgagccatgcctttgcatccttattcaccaacaggataatgaataacacagtaagaacagcagtagagccatttttcttcagccagattttcagattttccatattcttccgcttaattccctgccaatataagactaatattctgatcgaaaagacacacgaatattttttaaagcaaaatcccttaatttgcgagacggcttaaacaaaataatctaaaacctgatcacatcagtaataaaatttatccgcagccgttaataagttactttcaatatagccagtgaaaacaagagatatatccccatccaatgcttaatattgtctttttatgtaccaaacttattttaaattgctctcacattttcaaaaatctggttttttccaagggatttatttcataattaacacattacgtgtaacaaatcccctattcatccaactaatcaaacattatcaaaaaattaattcatagataagagatctaccactttaaaataaactaatgcaaacatcctttctaaaaattaccgcggccacggctgcgctctgtttcagtactctcgcaatagcccaaaaaacctattccgtaagtgggacggtgaaagacaaaaaaaacggtgagctgctcatcggagtatctgtaaaggtaagtgaagatcccgccattaatgttgttgccaatgaatatggcttttattccctttcactgccggagggaaattatactcttattatttcgaatccgggatataaggattttgaacagcagatcaaagtagaccagaatataaaacttgatcttcctcttattccgcaagaaacagagacaaaagccattgacgaagtagtggtaaccgctataaaaaaggataaaaacttaacgtctgctcaaatgggagcggaaacattaaacattaaaaacatcgaaaaacttcctgtccttttcggggaaaaggatgtgatgaaaaccatacagcttttaccgggtatcaaaagtaatggtgaaggaagcagcggattcagtgtaagaggcggcgctacagaccaaaacctgatattgctggatgaagcaccagtttataatgcatctcaccttcttggttttttcagtacgttcaacagtgatgccctgaaggatgccagcatcattaaaggaaacagccccgcacaatatggaggccggctttcttccgtactggatgttaaaatgaaggatggaaataataaagactataacgtaaacggaggaatcggtcttatcagcagcaggctaagtgtggaaggccctattcaaaaagaaaagtcgtcattcattgtttcaggaagaagaacgtatgccgatttgttccttaagaccagtaaggattataaagacaacaagttgtacttttatgatcttaacctgaaggccaattatcagatcaatgaaaacaaccgtatttacctgtcgggctatttcggaagagatgttctgggactgggagatactttcaatacagactggggaaatacaacagccactttgagatggaacagtattatcagcagtaagctattttccaatacatcatttatttacagtaattatgattataaaatcagtctgaaaaatgatgatacggtatttgatttaaattcaaaaatccgtgattggaatctgaagcaggattttacctggtttgcaggaaacaagcattctgtaaaattcgggctgcagtctatttatcacaccttaactccaagcagtgcttcaggtactacggtgagcagttttgcaagaaatccgagatactcctgggaaaatgcagtttacatcaatgatgattataaagcaacggagaagctgaccatcaattacggcgcaagactttccatgttcagtgtattgggaggtgatacctttaatacttatgagaatggaatacttaccgatagtaaattcttagagaagggaaaattcgggaaaacctatgtaaatcttgaaccgcgtatcagtgccaactaccgcatcaacgaagtgagcagtgtgaaaggaggctattccagaaacactcagaatcttcacctgttaagcaacagcaacagcggaaatcctaccgaccagtggatcggaagcagctatacggtaaaaccggaaattgcagaccagatcagtcttggatacagcagaaattttaataacaacaattatgaattgaatgctgaggtatactataaagacatgaaaaaccagatcgacttcaaaaacggggctcagattggctttgatacaggagcggatgtagaaagtgaactgttattcggaaaaggaagagcgtacgggctggaacttatcgccaaaaagaagagcggaaaacttacaggatggatttcgtatacgctttccaaaacggaaagaaagatcaacggaatcaataacaacgaatggtacaacgccagaatggataaaacacacgacctttctattgttgcaacgtatcagcttaatccgaaatggagtttttcaggactgttcgtttacagtacaggaaatgctgttaccttccctaccggaaaatatgagctgaacgggcaaaccatattccagtacagcaacagaaatgcagacagaatgcctgcttatcacagaatggacttaagtgctacttatgagcctagttccaataagcgtttccgcggttcatggacatttggtatttataatttgtatggccgtgaaaatgcctacaccattaattttgaagacaatcctgaccgtcccggaacaacccgtgccatgcagacctctttattccgctgggtacctaacatcacttataatttcaaattctaaatcatgaaaaatactttttatatcatattatctctcctggcattaacttcttgtgaaaaggaagtcgatcttgatctgaatgatcagagcggaaacattgtcattgaaggaaatgttacaaaccagccaggtccttacaccgtaaaaatcacaaaatcagttggtttttcagagcctaatcaataccccgctgttaccggcgcccaggttattttaagtgatgacgtgggacagtccgaaacacttcagtatacaggaaacggagtgtaccaaacctcaacttttacggggtcacccggcagaacctatacattgaaagtacaggctgaaggaaaagaatatactgcccagagcaaaatgcctgaagtggtttatttcgacggattgaagcaaagctcttttaagtttggtgataagactacttataccctcttaccactttttactgacccaataatgcttgggaaccgttatctttttatttttacgatcaatgatctccctaaaaaatacatgaataccatttcagacaatgtcaataacggattgcccaaccagcaacctctgatccttcctaatgatgataacaaaggcagagatcacgaagtagttgcaggagataaaattcatgtggaaatgcagtctatagacacaaatgtattcacctattacagtgcattgcttcagatttcaggtggtaatggaggaaccgctactccaaccaatcctccgagcaatatcagcaacggagcattggggtatttttcagcgcacacaacagacacggaaacttttgtaatccagcctcctgtaactccataaatttaaaaaggatattcatcgcagaatatccttttttatttttcgtttatctgaatcttcttttcagggaataataccgatacaaaagtttatcataccggatgacaaagaataataatccggcagtcactatcagcgttttcagctgaataatgctgtaaacaaaacctccaataatacatcccgaaaaaaaacaggcaacaatcaccagtttcagggcaatattttttttaagctggcgctgttcattttcccgctccttaaataacagctttgaaagctctattcccagatcggtaaacagcccggtaagatgggtagttctcactacagactgggatactcttgttaccaatgaattctgaacccccattgcaaaaagcaaaagcccggcaattgtataaggagatattgaaatacctaatggcttccctcctgatattcctacaaagctcaatatcagaatttcagtaatcaaaggaatgaggtgtggacgaaacattttacgccctgatgaaaattctaccataaagcttgagcagaacgcaccgccaagaaaacacagaataaagatgaagtatataaatgctttgcagtaatgatccagaagaatctcttcagaaaaaaaggcaaaatgcccggttatattcgtagtaagcactttaacagacaaaacacctgcaatattcacgattccggcaacaaatgaaagtgcggatgccagcttaaggttatgaaaataggttctgtttttccctctatgtctgaacattctgaatctctaagatatgtattgctgtaaaaaaacagctggataaaataaataagtaaaaaaaaataatttagaaatgtcagtatcaactgtgaaaaacatgtccgcttaaatatctatccagtgttctttataaatttactattgctctttattataaaacctgttgttttaataatgataacagatctgaaactgcgtccaaaagacctcgctgaaatgtctgtttcttatttcaggatcaatttcattacttttgtaaaagtaatccgttcaggaaaaaaatgttgtgatgctgatcatctttaaatgtgatttaagttaaaaactgagcgtattaacagcctgtaaagtaaaattatgatctcaaaatttattttcaacaatcaatatctttttgatgaacttcctgagtatgataaaaacctgcttacaggagcaatgaaaaccaaaaattaccgtaaaaatgaacctgtatttactgacggaacaaagcctaatggcgtttattatctgaatgaagggaaaataaagaaatataaggtggataatgacggaagggaacagattatttacatttacacctccggtgagtttttaggttattcagctattctgagtaatgaatcttacggtgacacagcatcaacactggaaaattctgtgatttcctttatttcaaaagacagttttcttgatattctcaatcagtcatcagtactttcaaggctgctgctgaagtctttaagtcatgaattcagtgtgatggccaatcttattgcagtattgtcccatcggaccgttcgggaaagagctgctctcagcttactgattcttcatgataagtataaatcaaatggcacaccagacaatgaagtattcattaccctttcgcgcatagatcttgccaatatggttggaactgccagagagactttggcccgcatcatcaatgattttaaacaggaaaaattaatcagatctgaaggacggaaaatacaaattaccgactttaagcagctaattcatattgctaatttttattagtaaagtaaatttctccgttttctactgacaaactgctgtcataagcacctgttacctttgtttaaaattagtttaaacaaataaagtacccttatgaaacttacctcattaagactcatcagtaaagacattaaagcagcagtagcattttatgaacaggttataggtatagctgccacatggtatacagaagattttgcagaactctctactgattctatcacaatcgctatcggaagtacccggacaatgcaaatgttctcagaaggtctgacagattttgcaggaacaaaatcaaccataatagaatttctggttaaagatgtaaacgaagaatatgaaagaattaaagagatagcatctgaaatcatccaggagccaacaacaatgccttggggaaaccgatctctgctgttctgtgacccggatggaaatatgatcaactttttcacccggtaagcgaagaggctgtgaaaaagttcagttaagttttaaacaactttatcagcaaaaaaataaaacctcactggccaacagcgaggtttttattctgatttttaaaagtcagtcttattttcccaggaattcaatagctttggcaacaaatgtatcatggtactggtaaaaagaagcgtgtcccgaattaggaaaaataaccagttctgcatggtctaaatgctgagccatatttttagcattctgaacagacaccggaaggtcattttcaccatgaacaatcagtaccggatttttaatcttttctatttctgtaagggcatcagcattaggctgggcccagctcaatacagctgtaaactgtgcgttggaagcagcatcactcaatggaatatctctgtctgtagtacggagctgaattctggcaaaagaagcttttccttccgcaatactctgtgcagattctgtaaatccgaatttaagaaatgaagcttcaggactcaatcctgcagttcctgcaacaatcgcaggcagattagacaacccgattgcgccctgtggtcctgtcccggttaaaattactttattgatcagtgacggattggtcagcgttattcgctgtgcaacaaatccacccatagaaaatcccatgatattcactttggtcagatttaacgctttgataaagtctaccgcatcatcggccattgcctgaacagtattgggagttgttccttttgaggaagatacacctttattatcaaagataattactttatactgttttgcaagaccatctgtcactgcaggatcccagtcatccatggaaccgcctaatcccggcagcaataccaatggaattccatcttcttttcctaaaacacggtatgcaatggagtttcccttaacgtttatgaattgggttttggcagtttggtggttcctgttttgtacctcctgtatcgtgggaggctcattttcttcagtgcaggatactgtcgctacagtaaaaagagttaggcataataagcttaaggcggagatttttctgattgttttcattgtagtttatttttgtttgattatggtgcaaacataaaacacaaaaacaggcagaacacctgaaagctttatcaacaggacattttggtgactcaattagacatttggaatagtgaaaattaaaacaggatgttcaaaatgttcttaaaacgttctattttgtttttaacatgctaagagttttcatcgctttatcagcatcttcttttgctacaaatatatggtcatggaaataagcggcgactacattacagctgatattttcgttttttagggcattggcaaaggcagcggtaagccctatggcttccagtgaagagtggacagtaagagttatccatgaagagatatagctgtaagccatactccattcatctgctatggttttctccagcacaatggtaacagcttcatgttcacggaagaaaaacagaatcttctctatctccggaacttctccgagggttttaacagtacaaaatacatattctccagcattcaataccggttccatcttttgaagcaatatcgctaagtctttttctcctgacattttttttgcctacaaaactaaggtacagatggcagcattcatttatcatttgataaaaaaatattcaatattattttatcagcaggtttaaagagattttctattcaaaaataaaaaaggaggcttgctgcctcctctttgtttttgtactgtaacctattaactgaacttcactatatgtgtttgtgttttttttgatcatttggttttttttaagaagtccgtttaaggttattcatacacttctttaatttcatcattgtgttattaattttcatcatttgtgtttttataactatcgtttattatttgtatagttataaatcatcatttgtttttttgtgtatgaaattctaataatcggagcaattctcatttgctttttcattatttaaatttcacattacaaaggaacaacattataaaataaaatcctctataaaccccatcgatacatgtcgattcatttatagatatttatcgataaatatgatattctgataaaatgaagtgataaacagcctttaaaaattatagtttatgatgggttttgataaggtcaacaagctcaaccatattttcgatcttcagtttttcaaagatattttttttgattgtgcttactgtattttgtttgatattcaggctgtttgaaatttccaggtttccgtacccttcagcatagagttctgcaatctgcagttctcttttggtcaaaatgctgagaggacttatcagatcaggattgtaaacgaactgtactaaaagattgcgtaaaagatcagaaaaatattctcctttttcgataaaagttgtaaccgcctcctttacctcttcttcttcactcagtttgctgaggtaaccgttagcaccggctttgataaatttaagtccgtgcagctcctcttcaagtccagtaaaaatcaaaattttaatatcaggatttatactcttcatctgaggaataatatgaagactgtttccgtccgggaaatgagcatcaatgatagccatctctatcccttttgattctaccaactccaatacctgatgtaaagatgaagtctggtaaaccctggcgttaggagcaatatcactgataacaatttccattccctgacgtacaatactgtgatcgtctgcaagcaggaatataatttctttatttagaattgatgtttccattagtattacgatttaaattgatcctgaatgtcacttttgttcctttgtgcagtttactttcaactgatatatcaccatcgaaaagctctacaatttcttttacaagattaaggccaagccctgctccaagattatctacttcatcagacaccattccctgataataggggtcaaaaattttaccaagatcagattctgatattcccactccggtatctcctacagttgtaatgagggtaattttattttctccggccggttctgtagacattacaagatcgatctgaccgttttctgtgaatttgttggcatttccgagaatattcatgaaaatctgattgattctgatattatccgaatataccattatatcttcagggattctgtccgttaccacaaacctgttgtttctggtttccagataaggggtaattacctttacgatagaactgatctcgttcttaagattaaaaactgattttataagttctttttcagcattttcatttttggtgtattccagaatctgattggactgcagaagcaaagtactgttcgtaaactttattgatttgagataatccctgattgtttcatcctctgtggttctgtggatcttatcaatgaaaatattgatgatttttaatggcgatcgcagatcatggctcaacattccaagaatcctgtttttaaaattaagattctttttaatctctttattcgcagcattaagtttttgttcataaataaatgcgactcttgtaaaatacatgatcagaatagatacgataaacatcagaatcattaatcccaataccagataagttcttattctgttattgtttgaactctgctcgttatattctttttccagttgggatttaaaatcattgattgcattttcgtacacctctatcaacccgttgctatacaccagcagcttactgaagttactataaaactggaggctgcttttctgattacgggcggcaaggagctgtacttttttcacttcagctgcgtaatgtttatccatagactttaatgtattgtccattttggattttacttcggaaagatccagcgttttgttgttcgtcatcgtaattaccgtactctccttctgtacatctacctttcctgttacagcatcttttagacgtccgaaaaagcctttctttttaatggtatcggcataagtacgggtttgaattttgaaatcttcaaaatcatttttatacttggcaggtacatactgcttatcttcaatattggcaggtggattcagggaattctggtataccgaatctattaatgttttcagctttgcagtctttatcgtatcctggcgatgaagagccaatgtttttttcagtctggggctggtattttcatacgctccaattttatcaaaattaattttaagctttctcaaagactggaaatataactgcagctctttattatcctgagtagccatatatttctgaagatgctcctgggcatccaggaaatcttttcttgaattgtctgtcaaaccacctaaggcacggctttcttccagctgatctttaataaatttcagcttttttccattgacaaattcgttataaaaaaatatggcgataatgacctgtatcagtaaaatacaaaggatcaatgagtaatgaacaagttttctcaatttaaaatttaagaatttatatttcatatttgtttatcagttaaattaatttcctgaccacataagttcatgagatattagcctataacaatataccattattttcaataatttcataatactgatatatcatccaattggcaaagttaaagtaatttttgtcttcttataataatgaatatttgataaaaccccgggaatttatttttttttactattaaaacgtcttacagacattcagttttatttacgtaaatccgtttttttagatcaattgcaaaagttggggtcttataaaatattctaaatctgtagatttattatatctgatgaataatatctaatcagcaacatatgaaaaataacagatcattacaatcaaatggaagaagtataatgcgggtttttcaggtttgaatttgatatttttacttatagaatattctttcctgtggttaaaatccatgtcagaattttaattgatgtctggccttcagaatttcttaagatttctactcattcattctaattatattcttatccatatcaccatcattagtattttctatttttctgatgaaatcctgagatgatattttcctaacttttcagtttgaaacgaagcagaatatcccggataattcatttgatgatctgagatattcaaaccaataacagcaaaacagctttatcatcttatgacagacaaaaattttaatcctcagagaggctttatattcagcaaacatgtgccggaggaattatcgcattttgaccgggtctttgatgtattcaaagatttgcttacccatacttccggagacattgaggaagccttcgagtggctggatatgcttgaccaggaatatgatattttcagcgatgaatatacgcttcaggattttgaagaagatctgaaaaaaagaggctatatcaaagaagaagatcccgaagagggaaatacaggaagcggaaaaggtaaaaatatattaacaccaaaactggaggcagcccttcgggagtatgccctggatcagattttcggaaaactgaagaaaaacggagccgggaatcaccgtaccagcaaaacaggaatcggggatgaacgcgatggtgaaaaccgttcgtatcagtatggagatgacctggcggcagtgaacatgactgaaagcttaaaaaatgcccagatcaataacggtatcgcagatctgcgccttactgaagatgacctcatcgtagaggaaaccaaacacaaggcgcagatgagtactgtcctgatgatcgatatcagccactccatgattttatacggtgaagaccgcatcacaccggccaaaaaagtagctatggcacttgtggagcttattaagcgtaaatatcccaaagattctatcgatattatagtatttggaaacgaagcatggcctattaagatcaaagaccttccctatctgaaagtaggtccttatcataccaatacagtagctggtctggagctggccatggatattttacgcagaaaaagaaataccaataaacagatttttatgatcaccgacggtaagccgagctgtattcagctgcccagcggagaattttatatgaacagttttggattggaccaaagaatcgttaaccaatgccttaacagagcggcacaggcgagaaaacttaaaattcctattaccacctttatgattgcgcaggatccttacctccgtcagtttgtagaagaatttaccgctcagaacaaaggaaaagctttcctgacaggactttcaggcttaggacaaatgatttttgaagattatgagaaaaacagaataagaagaatataaaaatcagaattctattaaaacattaccgtaaaatcttaccagataattagcattacaagacaatgaaaaacgatattacattcaaagaattaaaagactccggttacacctataaaacaattaatgaggagatccaggccaacctgattgccagaattaaagctaaagaacctgtatttgaaggtctctggggatatgaagatactgttgttccccaattgaaaaaagctattcttgcaggccaccacatcaatttgcttggactgcgcggacaggcaaaaacaagaattgcaagaagtatggtcaacctccttgatgaatatatgcctgttataaaaggatcagaaatcaacgacagcccgtttcatccgatttcaaaatatgccagagatcttattgaggagcttggcgataacactccgatttcctgggtacaccgctctcaccgtttctatgaaaaactggccactccggatgtgaatgttgctgatttaatcggagatatagaccctataaaagcagctactttaaaactcccctattctgacgaacgtgttttacattacgggatgattccgcgagccaaccgctctatctttgttttaaatgagctgccggatctacaggcgagaatccaggtttccctgtttaatattttgcaggaaggagatattcagatccgtggtttccagctgagaatgcctcttgacattcagtttgtatttacagccaacccggaagattataccaacagaggaagtattgtaactccgttgaaagacagaatcggatcccagattttcacccattatccaaaaaccattgctcttgcccgtcagattacggaacaggaggctttgatttctgctgaagataaatcacagatacaaattcctgaccttgcgaaagatcttttggaggaagttgcttttgcagcccgtatcagtgaatatgtagatgcaaaaagcggtgtaagtgcccgtctgacaatcagtgcgatggaaaatttagtagcagcagcaaaattacgactgattgaatccggtgaagagagaactactgttcgtctgcttgatttcatgtcgattatcccatctattacaggaaaaattgaactcgtgtatgaaggtgaacaggaaggtgccgattatgtagccaaaatgctgatcgacaaagctgtgatgacacagtttgaaagcatattcccacgtatttccaaactggaaaaagaaggaatcaaaacaccttacaccgatctgatcagatggttcaataaaaatcatctggaacttaattacaatgatacagatgaagaattctatgctaaacttaataaaatagaacctttggtaaccgttgttgaagaaaatgcttctgaactgagtgctgaagaccaaaacttctgcaaagaacttgtgttgtgggcattaaccatcagcaataaaattgataaatccgaaaaccagaatgccttcacatttgattctcccggaatcggtcagtttttacgcaattaaaaataaatatccttatacattagaataaaccttcagccggagtctgaaggttttatttattcacaaaatcgaaagttattcgtcaaaaaatactgtaaatttgccagtccatctcataaaagatggttttctattttaaatattatgaaaaaaacagcagtttctttattagcccttcttctgaatattgtttgtcaggcacagaatttcgatgtgattcctttaggaatatatggtggggagcaggaagataatttatcagcttatctggtaggtgccccgaaagacaatgcatttttatgccttgatgcaggtaccgtcaatgcaggaatccgaaaagccattcagttgaaaagccttgacggaactactgaaacagttctgaaggatcagataaaaggatatttcgtttcacacggccatctggaccatctttcaggccttattatcaactcccctgctgattctaaaaaggatatttttgctatagctccggtaattcagattttgcagaatcattatttcatcacagatacctggatcaattttgccgatcagggtcagaaaccaatccttggaaaataccattacaacgagcttcaggaaggaactgagatcccagctcctaagacaccgttctttataacaggatatgaacttagccatgtgaatccttacaaaagcagtgctgcactggtaagaagagacgatcactatctgctttatctgggagataccggcgctgaccgtatcgaaaaatccgaccgtcttgaaaatctttggaaaacaatagccccacttgttaaaaaaagacagttaaacaccatattaattgaagtttctttccctaacagccaaccggagcatctgttgttcgggcatctcactcctaacctgttaattgaggaactgagtaaactgaaggaaaagaccggacaaaacagtcttgagaacctcaacattgtggtgacccatagaaaaccaacaggagataatcctgaactgattaaaaaagaattattgcaaaacaatcctttaaaagtaaattatatttttcctgaacaaggtaaaaagatcaatttaccatagtgacagatcaaaagatggagcccaaacagactccatcttttttatgtttttttagtcattcaaccttctcttatagctggttcatattttcctttgggggctgcataacgataaacaaaataccaggtgatcaggatctgaaagagtataactgtaggcagaataaacggataatctacaaaaggtttcaatgtatcaccttttgccagcatcatcggcagatcaatgatattaaatataatgatgacccaaagtaatgctttgcttcccttaaaataccaccagcaaaatattccataggccagttcaatgataaaattaaggatcggataatcaagaattccaagccctaagaccggtttggcagagaatggagataactgaatatccttttcatgaaatattatatcaataataacatgggacaaaacaccaatagcaaatgctatagcaagctttctgtttttatacccccagttaataacacagaacgaaagtaccgctgccacaattcccaaaaaaacagaatgtgaataaggcagaaagtctagatgtaccttacccccggaaattgagaagtgttcccagccaaagtaattaaaaaatacccaacatacttccaaaagctgtacggagatcaatagtggaagtaatggcagcctgggtgcatttttctttatcagcaaagctgttgcggcatgatttattgcatacataatagaatgatttatggatacaaagatgccacagctattttacataggcttgtatgatctggctattcttcaataaaagagaaggagcctgcccgaacattcttttaaatgtacggttgaagtgtggggcatcggagaagccagcttcaagagcagaatctgtcatattattaccttctataagatgccgtactgccactaaaagttttgcccacagcatatacttcctgataggaatacccacctgttctgtaaacagatgaatgagtcttcccggagaaagaaaaatcaaagcggataagtcatcaatctttaacggctcattccatttttgtttaaggatttccagaagtcttataatcctttcatccatactatcatttccttctgtactggaaagttcacggagaaaccgtagtgtccggttaaaaacagactctgcagattcatcatcagaaagcagcggaattatatcttttaataattcttttacaatagcttctggcaaaactgctattctttgactagtcagaaacatgtttttaaggccattgcctattttgctttcaggatcaatattgatcaatagaaatgcattgtctcctgttctgcattcatgtggcacatcagaactaataataactgatctgttcttcataaccgatccggatgaaatcacttctatttcatcatcaatgcttatagcaatctgtatggcatgatgatcatgaacagcagtatcaacagcactgcctatataaataaagtaaccggtagaaaaaaacagcagcggatgtgtcatatcatattctatatctcaaagatatttaaattattcagacaaatcaggagagacaaattattattttgaagagtaagaagttcattacatccactttgtttcattattttaatgattgatttccaaataattaaacataaacctcaggaattaatatatttttttattgtttatacaaatttaatatcgtaatattgcaatataaaaataaaacaatgggcgttactaaaacagaaatttacacagaagaacaaaataagctggcttctttgcttaaagttttggggcatccggcaagaatcgctattttacagtatatcatcaaccaaaaagcctgcatctgtaatgatcttgttgaagaactaggattggcacaggctactatttcccagcatttaaaagaattaaagaatattggaatcatcaaaggttccattgaaggaaaatctgtatgttactgtattaatgaaagcaactggaagcagtttcagaatgaattcaacctgttttttaatcaggatgttactataaaacaatgctgttaaggcattttttttaaatcaatatatcgtaatattgcaatatatcattataaaattatcacactaaattttaatctgctatgagactatcagaaatcaaagaaattctgccggcattggaaaatgttgaatttcaattagaaaacggaaattttgtccctgaacatttccacgtaacagaagtgggtcagatcataaaaaatttcattgattgcggaggtgtaatcagaaatgaaaaagttgtcaactttcagctatggaatgctgatgattatgaacaccgtctgaaaccgggaaaactccttcatatcattcagctttctgaagaaaaattaggaatagaagactcagaaattgaagttgaataccagggagaaaccatcggcaaatatgatttggaatttaatggaaaaaactttgtgctgaaaagtaaaacaacagcctgtcttgctcaggaagcttgcggaattccatccgaaaaacaaaagaaaaacctgtctgaactatctgtaaatccaacatcggcctgcactccgggatcaggatgctgctaattaattttattaaaatcttatgtatcaggaattattaaatacggttcaatctcttaaatgggaaaagacagatactgacagaaaagaggttctggagccactgatcagctttatccagcaaaaagtggatgacagaaaggaagtcaacttgaattttatctgcacccacaattcccgccgaagccatctggcacagatctgggcacaaacagctgcttctttctttacgattccggaagttcattgctattccggaggaacggaaactacggcattattccctaagattgcagaagttttagcagaacagggcttttcaattttcagcattgctgatacaaccaaccctgtatatgctgtaaaatatgatgatagcaaccttccgataattggtttttcaaagaaatacgacagcccgttcaatcctgtatctgcatttgctgccatcatgacctgctcacaggcagatgacggatgtccttttattcccggtgcagaaaaaagaatccccattacatttgaagatccgaaaatttcagacaacactccatatcaaacagcggtctatactgaaagaagcttacagattgcagaggagatgttctatgttttttctaaaatcaaaaaataatcatgcagcccaaattaaaatttcttgatcgctatcttaccctatggatctttctggcaatgggtgcaggaattgctttagggcatttctttcctgatattcctgacatgattcaatcgcagtcaataggaacaaccaatattccattggcaattggccttatcctcatgatgtatccgccattggccaaggttgattactctctccttccgcaggcattgaaagataaaaaagtaatcggtatttctttattgctcaactgggtcatcggaccagttctcatgttctctcttgccattctttttttaagagatgaaccggattatatggcagggcttatattaatcgggctggcgagatgtattgcaatggttcttgtgtggaacgacctggccaaaggaaatagagaatatgcggctttgctggttgcattaaacagtattttccaggtgttcacctatagttttatggtatggctgttcatgaatgttcttccccgtcagttaggcttaaccgcttttaccataaatatttctataaaagatattagcgaaagtgtattgatctacctgggaataccgtttctggcaggcttcatgagccgttatattctggtaaaaacaaaaggaatcatatggttcaatagaaaatttgttcctgcaatctctcctgttacgctttatgccttgctatttacaatcatactgatgtttagtcttaaaggaaataaaatacttgaattaccgatggatgtagcaaaagtagcaatacctctgatcatctattttgtactgatgttttttgtaagcttctttatcaacaggtctttacatattccgtatgataaaaatacatccattgcctttactgcaacagggaacaattttgaactggctattgcggttgctatttccgtcttcggtatccattcaccacaggcttttgtgggagtaattggaccgttggtagaggttccggttttgatactgcttgtaaaagcctgcttattcatgaaaaagaaatggtactcataattcattacaataaaaagcttcactattatggtgaagctttatgtatcaatgatattaatttttgatcagcctgtaatttccgctggcttcatctttttgtattgagtaaccatctgccagttcaaggatccagccgtctccggatatttttttattttctgttttcactggatttgatatggaaattttatcccagttcgggctcattaaagctccgttttcaacggtcagaattccccataaatcagtcacccggatgttgggatataccgttcctttatcttctattggcataatatttcttgggtcaaaggagacattcattttttcaaatttgatttcaaaatgaggctgctgaatgaatttcaccttatattccgcaatgagtttttttgttcgttcttctcttgctgtttcctcttctacaattgatttaccattatagcgatcagacaggtttccaatcgtcttttcaagatcagacggaattattacattaaatgctttactgaaataaaccgtaaggtctgttttttcatcaatccttttattccagtctttatctttattgtacagcaagtagccataaacaggcgttgtatgataagcaaatgaacggacaaacgttggatttttcataaaatcatttattccattcaaaagagatgctcttgtctcttcattatttcttccgctcatgataagaccagtgaactcagcaataccttcattcagttccaacaggttttctgcagtttctgaatctttataaagtgtattcctgtattttctaaaagtcagtgcactggtcagatgctgcttcatttctttttgtgaggttgagcggattgcctgcttcaatgcttccagttcaagacgcagatatatcctgccttctttctggtcaaggtgattattctccacattactgagcgtaaatcccaatgaaggctggattctgtgaaatgattcatgggccagaagattaatcctgctttctttattctgagaaagaggcagcatgaccatcgcccatctttttccaccccagttgaccgctgtattcgcaatattgacagaagcaggcaaagcaccggaataaaccttaccgttctgcttcagaattccctccgaatcaggttcgttggcaaaaaattctctggtttcagggtcaattaaaataacaggaccatataaatctttgttccaaagtccgatattcttttttgaaactgtttttagctcatcaaaaaaaacggaaattgtatcaggggaaatagattgcttttgtgcttttacaccccatccaaacaagaaaaagaaggctgtaagaaaagtctgcttcatggtcagattctttgtggttttatcattaaatattaaaaagtacttattaattacttttggaattaccaatataatgaatttcaatcaagggtaaaaaccattgcattctctattatttcatatgccttttctgagtaaggaatttttctgatactacaaatattcaataaccatacaataaaaaaacctgctatctgcaggttttttgcaacatatcggaaaaaatctaaaattcaaaaacgtccggaattgtttttaataaaaacagagggttgttttcactaaaattccttctctttaaataggaatatgacgtgtgttcttagaatcgaatcagtaaaataatactttcaggaacattataatttatttacaaccccagtttctttttgatggcttccatttctgcttccagctttttaatcttagctttttgcagttctatttcagcctgctgctcctgaatagcttttgtaagcgcaggaacaagtgaagcataatcaacagcccaggcttcttttgtgtcatcttttggtttataaactgcttcaggaactactttataaagatcctgagccaggaatccgattttatgctgtgttttctggcctggatctacagccggttttccatttttgatctgattattggcagacagttcatactgtttcggctgcaatgccatgatggtactgagcccataccctatttctttaacctgggttttcagacgcatatctgaagtattgacaaaacctcctgcggcacttaccagtccgttaccgtcaatagtcactttagtactgccgttgtagctgtatttgaatccttctgcaccaagatagatctgagtaacggaaccattcaaggtattatatccgctcagatcaagatgcccttttgtagcggcaactttatttccgccaacacctcctgtttccggcctgttcatattgatatctccattgccatcgatgtcaagcatactattagtaccattagcataataatatctaaaacccgtagtgcccagtgttacctgagagaatgcggcactgctgctgtttccttttaaagtaagaagaccgttgtaagcattaatggcatttcctgccgctccaaaagcagtaatatcaccatctccgttgaaattcagctttctgtcagcgttaaaaagataatcgccaccgtttgcctggctgagcttaaattgggccacattattatttcctgctatagtaagagctcctcctatattgtttatgattcctgcattggcaccaccttctgtggttttggttgaagagttaagaaacatatccatagaacttccgacatcattagtaagccttaaaagagccgaagcattggtaccagcgttcaggttactgattgaggtaagtccagcgccatttacattacttctgaaatataaagccttatccgcataatcaattgctgtattctgcaaaagtgtgccaccaagcctcacatcattacctacagcgctaagaccattacttgctgttacagctgcagaattgtttccggaaatttcccatgtggaagccgctcctgtaaggccggtactgatcagctgcaaactctggttaggacttaccacaacaccggcattaccattaattgtttctgtgcctgcagggtttactgtaacggtaaaagctgtgttattcttaatggtgtacatacggcctttgaaattaccagtacctgctaccgcagccggcaatgtaaagacagcattggctgttccgttatatgagatatgaaaatctccggcggtcatggcataagtggcggcagttactgcgctgtactttgcggccagagagccgttaacatcaagagtggatccaggctgggctgtgttgattcccacactttgcgctgacataatgctatatgaaagcaaagctgccgctactgataatgtagtaaagtttttaaacattcttatataattatgagtttttaatgaggttaagaaatcgtatgaaaactgttatagatttggtttgtgatccggaccagtcagaataagtttcacacattgccgggatttgtcaacaaaatgaaatcggtataaccactttctgaaagattgaaatgaagaaaatcatgatcatattttttcattgtcccgtttttatttactacaaagctaaattttccgtcgtcttttccggaaaaacacctgtaagaaaattgccactctgatgtggaaaaattattacaaattaaatagagaataaatcattacgattttgtatacaagatctgaatctcaaattatatccattcctgatttattgataatattgtagaaacactgctgattgaaggctttttcccgaaaatagactacctttatgcggaatgaaatttttattataatgaagttagaattatatcagatagattctttcacagaagatatctttcatggaaatcctgcctgtgttgtcccactgaaaaactggttacccgatgaattacttttaaaaatagcccgcgaaaatgctgtagcggaaactgctttctttattgataacgggaatagtaccattcagctgagatggtttaccccggaagtagagatggatttgtgcgggcatgctacgcttgccactgcgcattgtctgatttctgttttaaattatccgaacaatactataatttttgataccaaaagcggtgacttaacagtacatgtaaaagagggaatttactatatggacttcccttccagaatgcctgagccggcttctcttccggatattataacgaggtctctgaatatacagcctaaggaagtcttcaaatcaagagattatgtgctggtatacgattctgaggaagatataaaaaatattaaaattgaaaggtctgttttcgatcttatcaacctggatccgggtggtgttgtggtaacatccaaaggaaccgactgtgattttgtgtccagatactttaccccacagtcaaccattctggaagaccctgtaaccggctctgcacactgctctctcatcccgttctgggcagcaaaactgggaaaagataaactttttgcccgacagctgtctgaaagaggtggccagctcttttgtgaaaacaacaatgaaagagtgattgtggcaggaaaggccaaaacttattcaacggggcacttttggattgaataataaaaagctgaatcattttgtctgtaaaacaacagcgcccagatacacataaagccttggacatctgatccagggctttatgctgattttaccggcaatctttttaaactgcaatttattgagttagttttacagatatccaaacagtctgtttcgggaaacattgttatatttgaacactattaataaccatccgctaattaaaaaatgaaaattttcatcactctgtttctgttgatctccggaattttgctttctcaaaatcaaaggtttgtttacgaatattcatttaagatggatacattaaacaaggataaagtagaaaaggaaatcatgaatcttgatatcaccaaagaaggttcctatttttacagtgcattgctgattacgcgtgattctcttgtgaatgctgaagttgaaaaaggaaaggcttcaaattccgttaatattgattttaggaagatcagacatccgaaagtcaatttcaggatttccaaaacatatcctgatctgacaacagtatatcacacttcacttaatgccagcaatgttgcagtaaaagaactgaacaagatgaattggacagttcttcctgaaacaaagaatattgaaggttttaaagctcagaaagccaacacgtatttcggcggaagaaactggactgcctggttcacgaatgatatccagatacaggacgggccttataaattttgtggtttgccaggtctgatcctgcagattgaagatgaagaggctacccatatttttaaattgcttggaagcatgaagcttaacaacgggttttcacttatagactcaaagactgcagaaatactcctgacaaaggaaaaattcaataagctttggaacgaatatatacaggatcctgccaaaaatatcaaactcatgcacagcacttccggaatgtctgaaacaatattatttgattcaaataccggaagtcctctgagtaaacaggaattaataaggaacaaagaaacacgtgcaaaagagtttctgaaacgatttaataattttatagaaaaggatttgtataaataattccggtattaggctgccatattaaatttttgggatttcgttttactatcaggcgtgttggaaaactataaagaaacacggcctcacaggggccgtatcttttattttttgtaatgtcagacataagctgacagaaacatctgaacatctcgttgtcatctttaaaattttaaagttatacaagccaagtctgatttacagacttttatttgcggcatgatcttcaggccaggcaaaaccaactcctccatgcttgtatctgttggtttcaagatagaatgtatttaccccctgaagtccaacaccagcataataaacaaatttgtcgacatattcctgatattcaccaaattctttatattcttgatggagaccattcaaactggccagctcttcattatgaatacgtaaagcctctgcacaagcatcctccaaagaaagattatattcctgctgtaatacaaaaaccagattaaaaacctctgtcccttttgccatctctttgggtaatgaatgaatatcattttgccacgctacaaccagggtcatatgggaaatcatcttttgtacgacgatatgctcaaagatatgttccggcagaacaagccctgattcaatttcgccaaaaatcaaataaggacgcatgagaacagaatactccctgatagttttgtaaagattcaatgaagggggacgttgggctattttatatggatattccaattctattccgtatctgaaagattgataaaaatagtaaacaaaacgatcaaaccagaggtctggcataaaagcgcgaaattcatcccggatcttttccatatgatgataaagtgcgttttcctccggcatagcctgagctcccttgagaatatctgtacagcggatccgtaacttctggatttcttcaagggatgagtgttccacctgatcatcgagagcaacatactgaagcataaacctgttgcatggaatagcttgctcatagcttaagtgtggccacatacgtgcggtacacatatgaagttccatttttttataaattttcctttgtttttctgtcagaaaagtataatcgttatcaatccagccatccatatccttcttcatttgttcagcatgcggattaataagatcgggccacggatagcatccccgtggtaaataatctgcactattaaattgttctggtgtcattttagtctatatttttaaattgttgtacttaaactcccatatgtaatcatactgaatcttcttccaagattatggcaagtgctcagtagctgatctagattttaatgaaatccagtcatcaatcagttttattgaaattggttatacctcaatgtttcttttaattcagaagcacttggaaattctgttttgttatatcggtcaagcttggttgatatatttttccatccgctcaataccatgctcatataatgcacccagttaaccacatcttcatgccacggtccaaaatcaggaagtgatgcctgcagtgttacaaattctttcagatcttcattatgaagccgcagatcttcaagacatgcttcttcaagggaaaggtgatgctcattctgaattaccttcacgatattatagtaaatacttccggtagcttcatctttctttacagactgcacttcattgaaaaaggttaccagatggcaagccagtgcctgcaggcggcgtactaccggatgttcatggatttcagagggaagaataactcctgtttccacttccgtaagctgtaaaaaaggataaagacatattgaatcctctcttaaagcaatgcactcctccactgtgggaaaaaatttatcttttttatattccagctctttttttagccctgtaaaatatctgctgatcatctggctaaaacgattcatcgattcctgaggaataaactgaagtaattcttgtcttaatgtggcaagcatagaagccaatggtattgtggattggataacagacatttcaccattcaatatcgcaatggattgggcatgcacatcatcaatgtcctctggtttactttcttcatacagatcatcattatagagtgtccagagcattaatctgcagataggccggaaacgttcagcagatgcagtaggaaaccattgggcggcgatgtgggcagttttggttttcttgtactttttacgcagatcagggttgttttgatacagccacctatattcaccatcaatccactctgtttcggtgatttgctgcaattgatctgcatgaggattttttaaagttgggaacggatacctgaacttggtatgaagaagttcaagagggttaaaattttcgttactcatgactttatgtttaaatggttgctattttttattgcagttttatttattggaatcttcataacaagaaaccatttataaaaacatactatcctaactaccagaaagatacaatcataaataatgaaataaatgtacaaattaattttgttaattaatatgcaattaatgctacattatataaatatgttataatgctgaaaaacaacatgttataaatactttccactaataactcaactttatccatcacgttatcagaaagttattacttaaaaaagatagatatttagttgaatttataattgataccataacaacctgatttactttaagttcggcgtgttatacttcagagtgacaactgaagtttacttaaataaccagtaataatagaaattcatcctaaatcaaaaacaggaaggaagaaataaataccacatttcgcgtaatggcaaaaaaattgtaatcatttgatcaaatagatatcatatgaacaatacagtaaaattagcattagccttagctgcaggaagttctttgctttatctgggcctgcgaaaaaagaacaaaaaggaaaagttatatcttgctcccgacggaaacacttataaagaggatcagatttaccgtacatatgacaacaaactttataagaacggtaaagcgtttcattataatgttccggaattacatgatgatcttaaagccacccatatgaatgatgaaaaagtagttgacagtactcatcttaactacaaagctgatcagaaaaatccggtttaccatcacaaaggtttaaggcatcaatagagtttagccatcaataccatcacacactacactaaccacaaaaaaataatattatgagaaatttattatggcttgttgcagtaatctgcatcgccgtatggcttttaggaatgctcggaataattccgggtatggatacaggaaatttaattcatacgcttttggtgattgccatcatcgtcgttgtgattaatctttttacagggagaaaacctcttaattaagatagattagtcattgttctgaataatgataaagatcttatttcaatacttaaactcaaagtccggaaatttccggacttttttctttttatctctgttaagaatttaaatacaatgattcgtttttctgatattttaagatttttttaagtaccacatctcgccagatatcgtatttaaggcacggcgcttgtaaagttaatactaccattttaaaaaatatacaatatgaacaacgaaaaaacagtgtcagtattaaacgatttactgaacattacaaatgacagaattcaaggattttctaaagttgaggataaggtatgggaacaatatcctctgttgcgtgcagattatgacaaaatggtgtcacaatcctacaccatgaaaaatcagcttacagatcttattacagaaagaggtggtacaccggatcagtctggttctgcagcaggagccatccacagagcctggattgatgtaaaaaattcctttgcaggagatactgcagatgcaacactcggaaatgtagtgtatggtgaaaatgctgctatcgatgcctatcaggatgccttagacagcggtgatctatgcccggaaagttcccgtgtagtgcttgatcagcttcaccagctgaaagcttctcatgataaatttgaaaatcttgaggatttaaaaaattaaaattatgccgcatctgaaagcggagtttcttacagtggctatcagcggtttttataggaggttgagccacttctttatcaacaaaaaaataaaattatgtcaaaaaagattgcaatactggccactcatggctttgaagagagcgagctgagctctcctaaagaatatctggagcaacaaggatggactgcacacattgtaagtcctgaaaacggaagcattaaagcctgggcagaaaaagactggggtaaagaatatcctgtagataagaatttagatcaggtgcaagcttcagattatgatgcattgatgctgccgggaggtgttattaatccggatcagttaagaaccaatgaaaaggcaatttctttcgtaaaagagttttttgcccagcataaacctgtaggagccatctgccacgggcctcaggttctcatcaatgccggcgttgttgaaggcagaaacttaacgtcagttcaatctatcagccaggatttgaaaaatgcaggagccaattgggaagatcgtgaagtggttgtagattccggacttgttacaagccgtactcccaaagatctccccgctttcaactcgaagcttgtagaagaaattaatgagggaaagcactaaatttatgtgacaatatatcataaaaatgtaaataaagaaggatgctgtaacagcatccttcttatttttcatgtcgagatttaccggattttttttaacagaccctagtctcaatgaaaggaagcccggaattccaagggtgacatctctgtttttgtcttaaacagtttgctgaaagactgtgaatgttcaaatcctaactcataagcaatttcgctgacggataaactggtggtagaaagcttttctttggctttgctgatgagtttatcatggatatggtgctgtgtactctgcccggttaatgttttgagcaatccgctcagatattttggtgaaacatgtaaggtttcagcaatatactgaaccgtaggcaatccctttatcgttaaatcatcactgtcaaaatagtccttaagcagattttccagacggcccagaatctgatggttagccttctctcttgttatgaactggcggttataaaacctttcggaataattaagcaggctttcaatctgtgaaatgataatctgcttgctgaaccggtctatattcgtatgatattcctgttcaatattctcaatgatgccgtttagtgttttttgttccttttcagaaagaaacagcgcttcattgacggagtaatcaaaataatcataccgtttaattgttttggcaagaggtgtattccatagaaagtctgggtgaataagcaacatccagcccgaaccttcttcaacagaagcggggtcagactgtatcctgaaaacctgattgggttctataaacgccatcactccttcatcaaaatcaaactcctgctgtccgtagtacattttcccgccaattccccttttctgggaaatcatgtagaaatccagcacgatgctaacttcactgatatccgaaggtcttttgatcgccgaataatcaaccacactgatcagaggatgctcgggctttggcaggccacgcagcaggtgaaattcactaatggtttttatcctttggatctgccgtttttccatcgttcaaaattaaaactgattgttagagcatttgtattaccaggctaactcgtttccgttcctgtcaaaaaacttacctgatggtacgtcttgtaaagttacaaattttacaatgatacctgcggcctgctcaggagtttgagtgccctgatattggttaagatttgatgccgtataaccgggttccacacttattattttaaaatctgtttcccggaattcttttgaaagaaggacggtaaaggcattgagcgctgttttggaggcactgtacgcatcatacatccggagattgggattcggagattcgctttgaatggaaagggaacccaaaggacttgacacattgattattcttggatcctccgatttttttaacagatcaatgaaagatcgggtcgtctgtacagctccgaaaaaattggtttcaaagacattccggagattgctcatacttccaccggacatattctgcggctgttcacctgcaattccggcattgttaatcaatatatccagctgctgttctttggattccaggatctgtctcgcagattgtatggaatgaatatccgtaacatctatttcaatacattctatattctgaaaacctgccctgttcagtttttcctgtgcttctgttccatttgagcggttacggcttccaagataaacataatggccaagcgcagccagctgtctggcagtttcaaaaccaatcccttgattggcacctgttatcagtatctttttcattttaatcttaaaatttacgtttactttaatgttttgcatcggtcttttaaaaataatgctgctgcatatcttccagaagtcctatatgcacaggtttccagcccagcatttcctgtattttgaggttactcaccgggcaatccattgtaataaagtggctcatccactcaaaatgcttctgaagttcttcaccggaaacagagattaccggcagatttagcatttcgccgataacttcagctattacttttatctcaatgctatgctcttctaccacattgtaccgcgctcctttatgtcctttttccaaagctaaacggaaggcctttgccgcatccaaacgatgtactcctatccagcggtttttgccggcatccggataagctgaaactccgttcttgcgtgcctgatgaattatgaaaggaatgaaaccttcatcacctttatcatgaaccgaaggggcgagcctgatcactgaggcattcactcctttttcagccaaagccaatgcggaagcttcagatgatctgagtgaattttccacaatgctgtcttcggttataaagccattaatgggaggcaagcccagcattcctgacgttaccacaatagctttatctgtgcccataagtgtttctcccattgcatggatggcatttttgtctgttgctgctgcctcagagaatgtagttgccccacccttcataaaatcatggttgaaaccacagtgaatgataccatccgtatcagcagcggcttgtttcaggatctcaagatcttcaagactgcctcttactacttcagcgcccagatcatgaatgatttctgccgatttttctgaccgtgccagacctacaacctgatgtccggcaccaattaattcttttacaactgcagagccgttaaagcccgatgctcctgttacaaatactttcattgtattactattttgttgaagcaaagttgcaatgatttgataagcgggatgtagtcaaaagttagtttgttgtagccaaaaaagaagacgtatgaaaaatgttttaactaaaaagcatcagactgagctttaactgtggaaagcctttagctgtataaaagaaaaaagctgtaaacattgatgtttacaacttttttgtatgttttggtttctaatcttgcggagagtgagggattcgaacccccggacctgttacagtcaacagttttcaagactgccgcaatcgaccactctgccaactctccctaaactccggctataccgttgttttcagtggtgcaaatatagaacgatttttagtttctgcaaaacttttcccgcacaaattttaacaaaacttaataatagactagaaatcaagggaattatttttcactctttcgctaaagtttcaatataaaaatctaaaacacccatgttttggggaatcctattatagaaaggcttttgtataacaaaacttacagctatatttacaaacacaccacatttttcactacatttgtaaaaacacaggtattctatgacaatggaaaaactaagaactttaagaaagcataaaggttatactcagcagcagattgctgatcttcttgctaccgatgtctccaactacagcagaaaagaaaatggagacgttaaaatatttgatgacgaatgggagaaactggctaaaattttagatgtttctgtagaagatatcagagaggagaaagcagcaactgttatacagaatcttacattcaacgatagtagttctaataccagcaaccaatctggcaactataatcagtattgtaatattccagagtatttattagacaaccaacaggaatacattaatcttctgaaagagcagattaaagctttaaaagaagaaaatgaaaaactgaaaaagggataatcacttttatataagaacaaaacggctcctattggaagccgtttttattttgtacctgtaaaagtttctattcccgatcaacaatggaaataaaactgttttttaaaaggtcagacgggtatacaaactgatctccatcttcaccttttaccacaatagcagcctgttcatcgttaaggcatttgtccagctgggttttcaggtcgttcagtgatccgttgggaacctgaataatgtaagttccggtgacatgtgtgattttgatgatttttctttccatattcttttttgattagggaggctaaatgtaaggatttaacttgacaccacaggaatgattgcttacccgcaacgtttgttattctgaagaatttaaactgctattttatcatcacttatgataggaatactttttggcctggattcctacggaatgataagcagaacgctttatctatgcgcacactttgtcattccgcaggaatctaagctttattaaaatattttagattccacgttttatctggttccgctctgagtgataagctttatggatagttaattgcaggttcccaatcacagacctttccgtcctctactctcctgccggttcaaacaattcgattttgtttccttccggatccaggatgtgtacaaattttccatattcatacgtagcaatctcatccagaaccgtaaccctttctttttttaattcttctaccagcgtttcaatattctctacatgataattgatcataaattctttggcagaaggctcaaagtactgggtagattctttaaaaggactccacagtgtatatcctttcttgccggatgcttcgtctttccagtcgaatttggctccgtacgggctggtgggcaatcccaggtgggttttataccattcatttacttgttcaggatctttacacttaaagaagattcccccgatagcggttactcttttcattttttataagtttttcattttagatataatgcaaagcagagacgtttgcagtttcacaaatatattaatgttttcattagatatttgattgtgtatttttttattggaaacgcaaaggcgcaagtgatgctaaaagactttttataaggcgcaaagattttatctccgataaaattatgtactgtatcatttttatgctggaaatcttcaatttccctgcgtcttacaataaagcataagacttaaaaatttgcgcctttgcgattatccaacaagaaaagtcatatatatggaaaatgaaaaagcgcacccttcgggtacgctttgtattgtataaactgaatagtattagtgtaattcagctaaatatttctctgcatccatagcagccatacatccgcttcccgcagctgtaatagcctgtctgtagatatgatcctgaacatctcctgcagcaaatacacccggaagatttgttcttgaagaacctttttctgttaagatatatccgttttcatcaagatctacctgtccaacgaaaatatcagtattcggtttgtgaccaatagcaatgaagattccttcaacatctacagtagatttctcctgagtctggttattgatgattaccgctctttctacaaggctgttttctccctcaatcccgattagctcatggtggaatttcacttcaatattcggagtattttctactctgtgaatcattgcttttgaagctctgaaaacgtcttttcttaccaacatagtcacctttttacaaagtttggcaaggtaagtagcctcttcagctgctgtatctcccgctcctactaccacgacgtctttccctctgtagaagaatccgtcacatgtagcacaggcagaaactccgcctcctgcatattttttttcatcttcaagacctaaatattttgctgtagctcctgtagagataataactgtttttgcaagaatttctttgtttcctgcgtatagcttgtgaacaccgcctttttccttagagaattcagctttggtgatcatttcgtaatgaactttggtatcaaatctttctgcctgtttctgcagatccatcatcatttcaggacctgtaatcccggctggataccctggaaagttatccacttcagtagtggttgttaattgtccgcccggctccaaacctgtatataattcaggttttaagtctgctcttgctgcatagatagcagctgtgaaaccagaaggtccagatccaacgatcacacaatctaaaatgttttgctccataatttgctttgttcgaaaagatttaatttgaattaagaccgctaatttcggaatttttaatttctttttaaagttattttaatgatacttgtcaatatctgatatgttgaatttcgatggttgctgttgtgggattcgggttccggggttcgggatgcaagttattttaaaacctttttacccacgaatcacgaatctcgaaactcgtaccgcgctacctcgtatcccgcttcacaccttcatcttaatcttatctacgttgatgatcttatacaccagttctctgatcagctcagcatctcccatattcaccgcaccaagtccctttcctttcatatcaaattctcttaaaatggagatgacccgggtagcatgtttcaaaggataaagccttgcactttccgcgtagtctttaataaaataaggatttacgcccatctgtgaagcaatagcctgcggagactgtccggccatagtctgataaataataacgttagaaaaataattgtaaaggcttgccagcatcatgacaaagggattattcttcgggttctttcccatgaaatgggcaattttaaaagctgcattggcatttttggttcctaaagccttctgaagttcaaagatattgtactctttactgatcccgatatgattttcaacaatggttccgtcaagaatttctccttctttaaggatcatcttcagcttgttcagctcattggcaattctggacaggtcgtttccaagatattctgccagaagatgggaaatattgggagcggtattgatcttaagctttgcacattcatccgaaatccatttgggaaggttgctttcctttacagactcgctcaggaaaagtgctttagctttatccaatgccttggctgcttttttcctgctgtccagttttttgtgtttgtgagcgaaaaccaaaaccgttgaaggtaccgggttctctacataagattccagaattctgttttcctcttcgttaaaccgtaaatcctgagcttctttcacaataatcacctgcttgtctcccatcatcggaaactgtcttgccagggaaagaacttcctggtaagtcgtatcttttccgtaggtaacggtttggttgaaggctttttcatcttcttccaaaaagttgtgttcaagggcttttacagcaacatcaataaagtaggcttcttctccgtggaaaaaataaataggtaaaacttctttatttttaatatttttgaggattaaatctaattctttcatcttattaatggaacttccaaaactgaattttcaggaaacttttgattttaaattcaagaaagacaaagataagttttttatttatgatttggtccgcaaaacttatcttctgctcactcctgaggaatgggtcagacagcattggattcattattacctgactgtaaaatcttattccacttctgccctgatcacggaaaaaaagattattctgaatggtcttaccaaacgcattgaccttcttatcactgagaaaactgaacctgtaatcctgatcgaatgcaaagctccacaaatcaaattaacggaaaaaacatttgagcaaaccgccagatacaattcaattataggagcaaaggaaattattttaacaaacggtttacagcacatcaatgcctattatgaaaatgagcaataccagttttacagacctgagtaaagcttacaatatcagataatttctgaaatgatttaaataatattctattaatattctttctgagttatttttattaatttcgataagattttctttaaacactaatatcacaaattgctacacaaattacaattgttatttgttgtatttgtgaaaaaggattagtgtagtttgtattaaaataaattacaaaatatgatacgttccatcttattaaccgcaatgattatggcttcaggaacccttttcagtcaaaaacttaaatctgtttcctaccaggacggttcacagaaacttaatggtctcatcacctccaatgccggaaaaaagcttccgggagttttgatccttccagcctggaaaggtattgatgaagaggctaaaacagccgctcttgagcttgaaaagcaaggttatattgcttttatcgctgatatttatggtgaaggaaagattcctgcagacaatgaatctgcggcaaaaacttcaggatattacaaacagaattatcaggaatatcagaaaagaatatctctggcattagaacagcttaagaaaaacggggctgtttctgacaagattgctgtaatcggatattgcttcggaggtaccggcgctctggaatctgcaagaggccatcttcctgtagcgggtgtggtatctatccacggaagcctggcaaaggatcagaccagaaaaaatgaagctttaacggctaaaattctggttgaaaacccggcagatgataaaagcgttacgcctgatgattataataacctcatcaaagaaatgaatgatggaaatgctgactggcaaatcatcacctatgcgcactccaaacatacctttacagatccgaaatcaccggattacaatgcaacaatggctaaaagagcatggaatcatactcttatgtttttgaaagagattttgaaataaacataaaaaggcaaattcataaactgatttgcctttattttttacctaaatctattatggtttagcttccagctcaacatcatatttctttggagaatacttggtcagtgatcctgttgcagcatcaattccaacacctattgctcctccaagaataatattcaataaagttacagcattaaagtttttcgtaagttttacttctttcttctcaaatccttctttttcgaatgtaacggtctgcttactcagagatcttgggatcttaactgtacaaggtgtggtacatttttcaattcctttgtgaaatacttttgccccttcaggattggaagaaaaagttatcggatcccgggttcctgtaaaaatggttgcacaagaagtggtagaaagtgcaatactgagtgaaagcacaattgataatttgtttttcatgattacttagttcatttttttaagtccgcgaacttacgaaataattcaaaaatcagaactatcaatggaggcaaatatttcaaaaaagatagtattgacggacgttttcattacctgcaaactgaaatctgatctcaaaatactcaataacatggagttacttgtattttaaaaatcagcataaaaaaagcaaatctgttattgtacaaatttgctcttttatatttattatcatgtttgctaatccacaccttcctcttccctgtgcaccagttccatagaaaatgcaggaagacagatcgcaagatactcacaaggttctgaaaacgggttactgtaacggattcttgctcctttttcaataaggatactctgacctttttccagtgtaacaatctcaccatcgatttcaaactgttttttcccggaaatgatataggtaaattcatcaaactcgggagtctgatgcggctcactccactcaggaggtgctaccatatgagcaatggaaacattggaatttcccgtagaatttccccagtgttcttcgatcagctttccatctgttgtggggacgataaatggagattgctgaattttatattttttcatatccagtcttcttttttaatttcataaacaaaattagttcttgtgggttctgcaaaataagccacttcttcctcagcaattttcttccctccaagtttttccatagccttttgagaacggaaattctcttttccgacatggaaatgaactttatctacaaactgaaagatataatccagcatcagtttcttaacctgcggattaatgcctttcccccatgactttgtcccatagaaagtatagcctatgaaaatatgattgtctttttcatcaaaatcataataacggctgcttcccaatacatctccggtcgctttttcaataattttgaaagctcctttactctccatagctcctctgaaaaagttttcaaaaacctcttttttgtaacggtccttattcggatgctgttcccaaacttcaggttcggaagctactttatataaagattcaaaatccccttgctgtaaggggattaattgaaattcttcattctctaaaacgggctgaacagaaaaattcattgttagctttttttagcagaatctgattctatctttttgatttctttcagcttgtcggaaatcttaattactgtgtctaattttgaaggcttcaaaggaacttctgcctgagccatatcccacttgatcaccagatttcctgagttttcatctgtaggattcagggtaatttcaaaccactcctgcttgtctgccagtttattaaccggtaccgtaacatctactacatcctgtttaggatcgtaagtataggcaccccactgctggaagtctttattcaggatcactttccattctttttctgtaggaacaatgaataagccgtaagttcctgcaggtactgttttccctccgaagttaacggcctgtccgaaagtaattttcgtagacgagttcgctcctgctctccaaacctggccataaggaaccagttctccaaaaatcttacgtcccttcactcctggtcttccataatcaatggtaattttagacattgaaaactgctgctcaaccttctggcgcggacttgctgccggtacagaataatcctgagcaaaactgaatgctgaaactgaaatgcaaactgctattattaactttttcacgtgtaaatttttgcttaaaattacaaaaatcaaaacgaaataactttcccaaacttcgttaatttttgttttaccgatatttttctataaagatattttgaactcaaattctttttacagatgaatctgatcttgatttttaccctgaataataagcttcaaaacagaatcgctttttccagctccagtaatttttgttttctccagattcctccgccatatcctgttaactgtccgttacttccgatgacccggtggcaaggtatcagaatggatattttattcaatccattggcatttgccacagcccttacagatttaggactgccgagaatatcagcctgttcctggtagcttctggtagctccatagggaatctcctgcaaaatgttccagacttctttctgaaacgcggttcctaccggagaaagaggaactgtgaattctgttcttcttccttcgaaatattcggaaagctgttgctcgagggtttcaaaatgaggattttcaccttgaataatattggctttacaatgagctgcaatgcttttcaattcggttgggagtgcttttctgtcggaaaattccagaaggcagattccattttcatcagcacaggcgatcatggttcccagcatggtttctattctcttcagatcaataattttctccatggtgttatttttaggagatacgccaaaaatatttttaaaactttcgttaaaaccactgagactttcatatcctgtatcaaatgcaacgcccgtaaccgattctccctgctgaagttttttaaatgctgtattaagttttgacattctctgaaaggcatgaaatgttattccgtggtgtttcagaaaccacctccggaccgttgccggttcaagtcctctttttacaagatcataatctttaagtttcaaggcaggatcgtccgcaatttctttaagcagttctttaatatattgtggtgtagcgttgagattttccaaaggtctgcacactttgcacggacggtaccctttcagcatcgcatctttggtactggagaaaaactctacattttcaaatttgggttttctggccgtacaagtcggtctgcagaatattcctgtggtttttacgcccatccagaatatgccttcaaatgaagcatctttggtataagatgcctcgtacattatttttcctgtgagttccatcattaaacaaaaagggttgaaaaacttttctcatttgtaatcttctgacccgttttttccagctctttataaatgtgtctgtacataaaagcacctgaagtaattcttttaacacctagttttttaagcgtgtcaaaatccggtaaactaggaaggctcatcacatttacaggaagatcggtagacgccgtaattgttctgatatcgttttcagaagtcagtccgggaacgaaaacgccgtcagccttaaattcttcaaagagtttaattctctccagggtttcctccagcgcattctccatattcagtaaaaaaggatctgtccgtacattgataaacatcttgcctctgttctctcctaatttgatgaaaatgtctttcaatctttcgtagaaggtatttttttctgtcaattttctttcaccttcaatcacatatgtatcttcaatattaattcctgatactcctatttctaaaagtttcaggatattggatgcgacggtatcattttcactgccatatcctgattccagatctacagagagaggaattgaaactgaagctttaattcttttgatgatataaaaatattcttcaaaggtcatctgttctccgtcctcatatcctaagctgagtgcaactgccgagcttgaggttgccaatgctttgtagcccagcttctgatatactttggcactttctacattccatacattacccagaagtaatggctcttcaccatgatgtaactgtttaaaactgatcataatttttttattcaaaagtagaaagattacagagtgttatacaaccgaaaaatgaacatctatttttttttaataactttaagatgaagttcaggtattaaaataaaatagctttttcaagctccagcaacttttgttttctccagattcctccggcatatcctaccagctctccgttggaacctatcacacgatggcatggaattaaaatggcaattttattgattccattcgctgttcctacggcacgtatcgccctgggatttcccaatagttctgattgttgtttgtaggttcgtatttctcccattggaatctcacgcaaaagctgccatactttttcctgaaacgctgttcccgtggtaaacaacggaacttcaaaatggcttctttttccttcaaaatattctttcagttcttcctcaagctgtacaaaatgaggatgttctttttctacgacttctgctttcaaagcctttgacaatgctttcagctgtttatccatattcttccggtctgtaaattcaagcaggcatattccctgatctacagcacaggcaatcatttctcccagcggggtggatatgtttttttgagatataatttccatcagcttaaaattaagctttttggaagattttttcttctttttgtttcgttaaaattctttttatctgttcaatatgccttgaattatggtaaataacaaaacggaaggtatctcccagcttcagtttgatcagctttgaaatacttatacctgtttttatcttttccagatcaacatgatgggcttcttccaacaactcaagcatcatttcctgttgttttatgaacgtattcactacacttttatccagattactgtggataggattcatcgctttaagtgttttcattgtattcagtttctctttgggaagcatgcttttggcaaaataattcccaagaatcccgggtttaaaataagatcgtgaaaattttccggctgaattaatattgcgtttgatttcaggaatataaaaatctccgtagcggttgagatgttccagacattccaatgcactccagctgtcttctgaaattctgaaattgagatcatcttccggttttacagacagcattgcagcaaactctaaatgctcttttgtcctgttttttaattcatccaataatactgaggttgagattttcattacgttttttatgcaaatatcctcatctgacaattcttaaatcttgactgaactcaagattttttgagtctggataaagtttccggtgacatcctcagataattggcaatatatttattgggaacttcctgaaacagcttcggacttcttttcagaactctttcaaagcgctctccgggagcattgatgagcagatctttctctctttccagctgttgtaatacgagatcttccagaatattcatccagaacttcatatgttctgcgtctgattgcataaactcataaaaatctttttttgaggctgtttttaccattgtctttttaatcgcctgaatataaagatccgaaggcttacccgataaaaaggaatccagactgacaataatatttccggtatatccgaaacgaataatcctttcctcattttcatccatcataaagatccgcacgcttccgctttcaataaaataaatagtggtgtctgtacttcctgagattttcaggaactcatttctcctgaattctttcttttcccaatggattccgctttgaagcaatttttcaaccatttcattttatttatttgcttttccaaagataatgggtaattttaaagttttaaaacactaatcactgataatgctcaaaagaacagtccttttcacactgctttctgcaggattctgtacaatgaaagcccagcagaccattcctttcagaattacaaaacacaataatatcattgtgaaaacgctggttaacaaaaaagattcactagatctgatgttccagattgctatgaaagatgatgcaatttctcctgatggtaagaaaaaggcgggtcatattattttcaataaagaagaactcagcgatgataatacagttgagatcggaaaaatcacacaaaagaatgtacgcttttttaataatcagttgacaggacatgaagctgatggaaaaataggaaccggaatttttgagggtaaaacttttaaaattgattatgataacaatcaatttgtgatgtatgatgccatgcctgatgtgaacggttatcagcccatcaatattatcttagatcatgatggattttatctggccgctgataatgtccttgagggtgatcaacagcaggaaacctattttgttttacaatcaggattctccggagcaatattgtacagcaacaaatttgctgaagaaaagcatctggagaaaaaactgaaagtaacgggagaaaaaacgctgaaaaattctgaaggaaaaactttaattaccaaacaggctgttctcccttattttaaattgggaaacagtgtattcaaagacgtatctgtagggttcttttcaggagagctgaaaacacaaaatgtcagttatctgggtgctgatatgctccgcagatttatctggatattcgatgccgacaggaaaacggcttacatcaaacccagcaaatatttctcagaaccttattacaaaatgaattagaaaaatgataaacactttaatgctaaaaaaaattatgaaacccaaaacggttgctgctcttttatttttaccattggctgttgtaagctgcaagaaagaagagaaaaaaacagctgccacagaaacaaaaatcaccaatgacactataaaaacgacaaaagcagaagagaaaatagattattcggatttcaatatttttaatctgtctgtcatgtcatcagctgaaaaagattctgatatagatatttttatttcggtttcggacatttacaagggggctcagcctgttcctgaaaacattattaaaaaccataagcagatgacttatgaagaactccagcattttgatctggatgctcccagcagaaaaaaactgctcaacggaattcatcttaccgaaaatgattccctttatatttatgagtattggtctaataagcttcagagaatgccggtgagccaattaaaagctgtggcctatttaagcccttattcagacagtgaagatttggatccggatgcttatatgatgggatttcaggtagcaacgcaccaaaaaacaacggagtacgaccggtacattaatgctatcgcttattttggaaagaaaaatcctttcgttgagaataaaatgaaggctgtaaaatggcaaaaagccggtgctgatatctcaaaaaaatactttagccattcaaaacttactcagggaaatacctaccaggcgaagtatgaaaacatgacctattatctgcaggattatcttgaagaaggaaatacggtggaacgcaggcttgcagtcattaatgatcatcaggaaaagattgcagaaaaaacattcagccttgcagaaagtgatggcggggaattccttcctctgtatggaatagataccgatgaagctaatatattccaatacacaggctatctttttaaaggaaaacctcctgttattttcggattcattgcacagtcttttggctgtccttccattagttttttagataaaaatgagaaagatttttggatcaactgtgataacaggcattaaggaaaaaacaaaatggtaaaatgctgttttacacttaccatacattatgaaaatacattatcaggagcaggttaacagcaaacctacacatgtattttcatagtgttcatcaattatacaaccgctgaagcaatcatcgacatataataattggcacagtgcaatgcattgatcagtaatatttctttagccgggtacatttcgaatttttctgtggtagtaatctgatattcatagttcatggaactccacttcagatgcggtttcattacaaatagttcatttccctgctgatcggcaaggacaaatgattctttgaaaattccacggtgcttgaaaagaaagccttcttttacgctatcaaaatatgtctgtattacaatttcaccattccagttcatccgaaacttaaggagtactttttcattgtccttaagttcaatggtggttccccagaaacctttgggctcaatgagataaaaacggttggcaatttcaatctcagcattaaacttaaaccagctttcataaataagcctgcctatcatctggctttctttggtgatttcaaaggataaagagttgtgtgattttgcgtaatattctgccatggctgtattttggtttggtgaattttattagtttttcaaatagtaataacggcctgaattttaacgctctaatttataaataattcggtaaacataatgtatttttaaaagtgatctgataaaaaacgattaattattaaccatggccgtttttttccagatttcaattgaaaaatgttgaaaattatttcataattagattcaaacctaacagattttagaaacctgttaggtttagcggttaaaattgcttatcatgtcatactattctttcttatgaaatagcatctcatttttacttattcaattttaaatatataatcatctttaatgctctcggattttttgattatctcgtctatactatatttttgtccgtcaatttcaacatccacgatataccatttccacataaaattatgagttttttcaatccgcactgttgaatgagggttgatttccagcgtggtaccggagctgtcaagctttttttcaagagattttaaatttttattttttctaaaaaattttggctgtacaatatcgttctcataattgaaacttagtgttccataaaaaccttcagataattctttgaccattctttttttataattaatcttcactgttttcttcgtttcagttaaattctgaatataaaagtctgttgggattgaacatccgcaaaatacgagcacaaaaacagcactcaaaatacctttaaaaattgcattcatataattttagctttacatggtttttacaaaaataaacagaatcttctgtctttagattaacagataaaaaaattccgcaagaaaacttgcggaatttaagtattatttctgttcgaaaattacatcgtctccattttgaagctcatgctttcgattacttttagaattgcttctaccgtatccattgaagttagacaaggaacaccgttttccacactcattcttctgatctggaatccgtctctttctgcctgtttaccttttgtagtggtattcacaacatactgaacttttcctttctgaatcaggtcgataagatttacattttcctctcctattttgtatccgatcttgcaagggattcctttttcttcaaagaacttcgcagtcccttccgtagcccagattctgaatcctacttcatggaatcttgctgcaagcgctgccgcttcttctttgtgcttatctgctactgtgaacaggatagaaccgtgcataggaacttttcttcctgctgctaccaatcctttgtataatgctttttcaagggttgtatctttccccataacttctcctgtagacttcatttccggccctagggagatatcaactttcgttagtttagagaatgagaatacgggcacttttacaaaaactccttctttgtttggaaccaatccgttttcgtaacctaagtctttcagcttttgtcctaagattgcctttgttgcaaggttagccatcggaacgtctgtaattttagataagaaaggaactgttcttgaagaacgagggtttacttcgattacatatacatttccttcgaaaagaacatactggatattcatcaatccgataacattcagtccttttgccagtctcttcgtatagtctaccaaggtatcgatttcactctgagagatgttctgtggcggatatactgcgatagagtctccggagtgaactcctgctctttcgatatgctccatgattccagggatcaccactgtttcaccgtcgcagatggcatctacttcgatttcttttcctaccatgtacttgtctaccaaaacagggtgttcagggcttgcatctacagcgtgctccatatagtgagccagttctgattctgcatatacaatttccatcgctctacctccaagaacgtagcttggacgtaccaataccgggtaaccgatttcgttggcaatttttatggcttcttctttcgaagttgaagttcttccttttggctgaggaattccaagctcctgaagtgctttttcaaatttatctctgttttcagctctgtcaagatcttccagggaagttcccaggatctgtactccgtgagaggctaatttatctgcaaggttgatcgcagtttgtcctccgaactgtaccactactccttttggtttttcaagctcgatgatgttcattacatcttcttcagtaagtggctcgaagtatagtttatcagagattgagaagtctgtagaaactgtttcagggttgttgttgatgatgattgcttcataccccatttctttgattgcccatactgagtgaacagttgcgtagtcaaactcaactccctgtccgattctgattggtccggaacccagtacaacaatcttttctttgtcagaaactacactttcgttttcttcttcgtatgttccgtagaaataaggggtttcactttcaaattcagcggcgcaggtatctaccattttgtaaaccggcattacaccgttttcttttctgaagttgaagacttcacgctctgttacctcccaaagaacggcaatattgatatctgcaaaacctaatctcttggcttcagttagtgtttctttatcaaatttgttggcagcgattactttttcaaaatcaaccagctttttaagcttccagataaagaacttgtcgatcttactccattctacgatctgttcccagtcgtatcctcttcttaaagcatccccgatgatgaataatctctcatcatcacacactctgattcttctttcgatttcttcagcagtaagtgcctgagcctgttttgtctttaatcctaaatgtctgattcctgtttctaatgaacggatggctttctgtaaagattcttcaaggtttcttccgatcgccattacttcaccggttgctttcatctgggtggaaagtcttctgtctgccgtttcaaatttatcgaatgggaatcttgggaattttgttaccacatagtcaagagcaggctcaaaacatgcgtaagtttttcctgttaccgggttcatgatttcatccagcgttaatcctacagcaatctttgcagcaatctttgcaataggatatcctgttgccttacttgccagtgccgatgaacgggaaactctaggatttacctcaatgatataatagttgaatgagtgcggatctaaagctaactgtacgttacatccaccttcaattcctaaggctctgatgattttcaatgaagcgtttctcagtaactgatactctctgtctgaaagcgtctgagaaggtgccactacgatagagtctcctgtgtgaactcctaccggatctatattttccatgttacaaaccacaatggcgttgtcgtttgcatcacgcattacttcatattctatttctttgaaacctgcaattgatttttcaataagacactgtgtaaccgggctgtgctttaatcccagttcagcaatttctttcaattcagcttctgtggaagcgataccacctccggttcctcccatcgtaaaggcaggacgaacaattacaggatatccgatttcatccgcgaaagcaagggctccttctaccgtgtttacgatatcagattccggtaccggctcgttcagttctctcatcagctcacggaaaaggtctctgtcttctgctctgttgatcgcagaaagctttgttcccaatacttccactttgcattcttcaagaattcctgatttttccaattctaccgccatgttaagacctgtctgtcctcccaatgttggtaataatgcatccggacgttcttttctgatgatgtggcttacaaactgtaatgaaatcggctcaatatatactttatccgcgatttccacatccgtcatgatcgttgcagggtttgagttgatcaaaattaccttgtagccttcttctttcagagacaaacaagcctgcgttcctgcgtaatcaaattcagctgcctgaccgatgatgataggtcctgaaccgattactaaaattgtttttatatctgtacgttttgccatttttcttttttaattggggttaagaatcaaattcttaaacttcgtattttttacttttataagacttacaattgtactttgtcattccgtagaatctaactcattatagttgagattcttcattacgctgctgcctcactctgaatgacaaacaagcagtcttatttcttaaagtcttccatcatttgaatgaactcatcaaacaggtagtttgcatcttcagggcccgggctcgcctcagggtggtactgaactgagaaacaagggtggattttgtgttttaacccttcgtttgttctgtcgttcagtgcgatgtgcgtttcgataaggtctgttccttttaaactttcctgatctacagcatatccgtggttctgagaagtaatagctactgtatttttctcaaggtctaacaccgggtggtttcctcctctgtgtccgaatttcagcttgaaagtttttgctccgcaggcaagaccaattaactggtgccctaaacagattccgaagatcggaacttttcctaataatcctctgatcatatctaaagcatgtggtacatcttcagggtcaccaggaccgtttgacagcataattccatctgggttcatcaacaggatttcttctgctgttgtgtcctgagaaacaacgatgatatcacagtttctttgagacagttctctgatgattcccagcttggcaccgaagtctaccaatactactttgaaacctctgtttggattagcataaggtgtttttgtagaaacttcctctacctgattggttgggaaaactgttgatttcaattctgaagctacagctgcttcgtcagcatcagcgtttacgatttttcctttcactactccgtggttacgaagaactcttgtcagtcttctggtgtcgattcctgaaattcctgaaaggtttttctttttaaataattcatctaaagtgatctgagtacggaagttggaaggaagatcgcaaagttcttttacgataagccctttgattgccggctcgatactttcataatcatcacggttaataccataattcccgataagcggataggtcatacaaactatctgaccgcaatacgacgggtcagaaatcaattcctgataccctgtcattccggtattgaaaactacttcccctgcagtttccaattctgctccgaaaccttctccatgaaacacttcaccggactccagtattaattttttcttcattttaaacttttatctcttattatttatttatatgtcattaacaggccgcctctacggggctctttaccttttaacttcttacttttaccctggctattttaccttgtcaaattatttaaaggtataccctttactttccagcgcatctttcagaatagccattcttgcgaatacgccgttttgcatctgcttgaagactcttgatctttcgcattccacaagttcagagtcaatttctacccctctgttaataggagccgggtgcatgatgattgcttcttttttcatcgcatgctctctttctttagtcaggccgtaccttttatggtattccgaagcggtgaaactcattgctgaatcatgtctttcatgttgtattcttaacagcatcagaacatccacttcaccgatcagctcatctacggacatataagttccgttaatcagtgctccttcgtcaaaccactgttccggtcctgagaaatatactttagcacctaatcttctgagtgcctctgcatttgaattagcaacacggctgtgttttacatctcctacgattcccactttcagtccttcaaactttccgaattcctgatagatggtcagcagatccagcatacattgtgaaggatggtttcctgttccgtctcctccattgattacaggaatgctgatatttttaagttcctcgaagtatctgtcttttttatcacggattaccacaaggtttactcctatactttcaatagtctttactgtatcataaagactttcgcctttgtttaccgaactgtgtgatgcatcaaaaggaactacctgaagtcccagttttctttccgcaaggtcaaaacttgttttcgttcttgtgctgtcttcgaagaaaaggtttgagcaaaaaacttctccttcaattttagcagttttaccatttgcaaaagccattgcttctgtcagtatactgttgattctctcggtgcttagttctgtaatcgtaaacataattcttattttttggcataaaaaaaagcgaagacaactatcttcgcttaataacaataaatatcgtaaagggcgctttcgcccggtaaatctaatgatataaatgcttttttattcattaggtgcaaagatacaacaattttatgaacctacaaaaattatgttcaaaataaattaaaaacttccgtctttccttattctcattaaaaattaatatttttgttatcactcaaatatattctatggatttaaaagacaaaatgattctcagtattattcaggaagactctacactctcggtaaaggaaatttccgaaaagataggtcttacctttactcctacgtatgagcgaatcaaacaattggagaaacaggggatcattcagaagtatgtgggccttttaaaccgtgaaaaactgggtttaaatattgtagtctactgtaatgtccgtctcaaggaacaatccaagaaagtattggaaacttttgagaaccatatcgggaaatatgatgaagtacaggaaatcatcagtctttccggggagtatgactatatgctgaagattattgccaaggacatcaattcttataacgaattcgctgtgaatgttatttcaaacattcctaatatcgggcagtaccacagttctatcgtgcttcacgaggtaaaaaaatctaccaaattcaaaattgatctggaataatcccttaattttaaactcattattcattcctatttcaattactgaaaatctttgattttcttgcgtcttaaaagtaatatctattatacaattccttgcgcctttgcgtataccaacgctttttatttctaatatcttgttagaaaacgcaaagacgcaaaagaaatttattaactttatgctttaaggcgcaaagattttatctccgataaaattttatgcagcagatttactctcaatttccaaccatagtcagttaaagatcaatcatcaaattcaaagagcggagtaaaatccaaccattaagatcacttaagcagataagatttattaagattaaggtttctacaacgaaaagacagcaggctaaaataatttagaaattccactgatttttgcttaagttctgatgaccttaatggcttagattctaacccaataatttatttttcagtttattgaactgatattctattttatccagacaaaggttgccgatacttccctggtgggtatgttcaaggttgccgggttcaaattcaaattcattgttttcaatctcctgccccacttttacatacgcatcacggaatgaacttccgtttttaacctcttcattgatcttttccacactgaaaaggtatttgtacttctcatcttccagaattccatcttttacctgaatattcggtaaagtatagcttaagatttccagacattccttcaaagaatctatcgcagggaaaagaatttccttcgtcaactgtacatctctgtgatatcctgaaggcagattgcttgttaaaagaatcagttcattgggaagagactgaattctgttgcaacgtgcacgaatcagctcaaagatatccggattctttttatgaggcataatactgcttcctgtagtaaattcttttggaaagctgataaaatcgaaattctggctcagatacagacatacatcgtaagcaaacttccccagcgttcctgccagagtcgccatagccatagccagcattttctctgacttcccacgggtcatctgagcgtacaccgagttataattcattgactggaaccccaggttataagtggtactttcacgattgatagggaatgaagaaccgtaaccagcagctgatcccaatggatttttattaatgatattctttaccgaaaacagcatttccacatcatccaaaagtgcttccgcataagctccgaaccacaatccgaatgatgaaggcattgcaatctgcaaatgggtatatcccggaagcagtacatttttatgttgatctgccagttgaattaaaatctggaaaaactcatctgtaagcgatgttatttcacggatttcatccagcaaatacaatttgatatccagtaaaacctgatcatttcttgatcttgcggtatggattttttttcctgtatctcctaattcttcaataagaatagcttctacctgagaatggatatcctcagcatctttatcaatttcaaaactaccttcttcaattttgtataaaatactgtttaaaacagatagcatctgttctgattctttctgagtgataattccggtttctgccagcattttgcaatgcgccatagaacctttgacatcatatttagctaaacgctcgtcaaagtcaagatctttaccgactgtaaagttattgactaatatattggtggcaaggtcatccttctgccatatttttttcatgataatatttgatttaaatattcgttggttttgacatgcccggcaaggcaatccttattactattaactataaaaaaacatttccttatgtaaagccttcatttctaattttcttcttgcataaatcttattaaaaactaaacttttagcgcctgccggacagagtcaaaacatatattgagctggaagcctgaggctggagctggaagctaataacatgcttcaataacttccctcttcctacacccatcttccatttttataacactttttctaaaattctgatgtagatttctataccttcttctatttcatggatatagataaattcatctgcagtatgggagcgcctactgtctccaggtcctattttcactgatgtacatggaataatagcctgatctgaagaggtaggtgatccgtaagtggtccttccgatttcaattccagcttttacaaacgggtgatccatttcgatctttgaagaattgagtctgaaagatctggccgtcagtgtagatttcatctgagactgaatgatttcaaatgcttcttgattggaatattcatccgttacccttacatccagtgtaaaattgcatgattccggaacaacattatgttgtactcctgcatgaattcctgataaagtcactttaacttctcccagatattccgaaacctttggaaatttaaaggcaagaatattctgcagatcctgcatacattttataattgagttatcatcattaggatgagcggcgtgagaaggagtccctttcatttctccatcaatcacaagaagtcctttttctgcaatcgccaggttcatctgcgtgggttctcctacaatggcgagttctacgttgggtagctgcggaaataaggcttcgattccatcaaatcctgaaatctcctcctctgccgtcaaagcaataactaaattatattttaaatcttctttatcataaaaatgtaaaaaaacctgtgccatagcaaccagagacgccccggcatcattgcttcccaatccgaacagtttcccttctttttcgataggcaagaacggatcaagcgtgtacgctttattaggcttcaccgtatcatgatgggtattcagcaaaacagatggcttaaatacatcaaagtgcttgttcaccgcccagatgttgtttttaaaacgcttggtaggaatctgatgttttttgaaaaaattctcgatttctacggacgtattaaattcatctttactgaatgaaggaatttcaatcaaattcttaagcaatccgactgcattattcaacagttcttctttattataaacagatttcagttcctgcatgatgattttctatatggtttttcagttctgtttctttgatcagaaacactttatttacattattctttatcgctccgagagcattttcaagtttgggtaaaatccctttgtgaagttttccttcttcttttaataccgtgaattcttcctcatttacacttttgatcacagattccggatcgtttacgtcctccagaacgccttctttatcaaaacagtataacaattcaacctcatatttctcagagagtgactgtgcgatcacagaagcaatggtatctgcattggtattgaaaagatttccttttctgtcgtgggtaatggcagaaaacacaggaacaagatccatctttattaattttgaaaccagcttcctgttgacacttttcttggtaatatctcccacaaatccaaaatctatttcaggatgttctcttttcttagctttgatcagatttccgtctgctccggaaaatcctatggcattgcattttttctgctgcagcttttcaacaatgttcttattgattcctcctgcatataccatcgtgacaatatccaatgtttctttatccgtaatcctccttccgttgatcattttctgttctatccccagtttatcagccaacgttgtagccagctttccaccaccatgaacaagaattttcttttcattaattccggaaaattgttctaaaaactgatccagcaattgttcatcatcaatgagtgctccgcctatttttatgatgtatattttctgtttcattagaaaggattaaagattaagattatagggtgtattattacttaatatcatccaaaatttcactgaacacagcctgtacagagaaaatacggttttttgcctgctgataaatgattgaatggtctccatccattacctcatcactcagctccacattacggcgaaccggaaggcagtgcatcacttttgcattattggtattggctaatttttcattcgtaagcatccattcgccttttacttcaggcattgctgcataatcatcaaaagaagaccaattcttcacatagataaagtctgcatctttcaatgcttcatcctgatcatggattacttttacatctttggtaaaggttttatctaaatcatacccttcgggattggcaatcaccaactcaacatccatttcctgcatccactcggcgaaagagtttccaacagcgtgcgcgataggtttgatgtgcggcgcccatgttaataccactttcggcttgtgatcttttttccagttctctgtaattgtgatacaatctgccagactttgcagcggatgacgagttgcagattccaatgaaaccacaggtacctttgcatgcttttcaaactggcttaagatgctttcattcacatcatcttccttgtttttcattcctgcaaagcaacgtaccgcaatgatatcacagtattggtttaacacttcaatagcatctttaatatgttctactgtatcaccgttcataacggctccgtcagcaaattcaagattccaggcttcctgggctgcatttaatgtcaatacattcaacccaagattctgagcggcaatctgactgctcagacgggttcttaaacttgaatttaaaaatacaagccctatcgtttttccctttccttttgctgtttcagtaaggggatctgcttttatctgtaaagctttttttatgatttcctgtaagttttctacatcacttacagaggtaaattttttcatttggtattttctattttttttcaatggacaaatggaatatccatttcattttgaattgattttaaagattttgcttacacatttttgagagttttaacgcaagggcgcaacgcttttcactgatgcttttttcgttcgcaagggcgtttcactcagcaattgacgtttgtttttatcattctgagattcttcatttcacttcgtttcattcagaatgacaaacgcagcgttaaagcttttaacctttttgctatttcgtcatttgccttttaaatatttccaagcactgctttcaaagcattgatgaaaagatccgtttcctcttttttgatattgagcgccggaagaatcctcagcaccgttttatcattcgagtttccggtgaaaatatgatgatcaaaaaggagctctttccttatttctgaacagtctctgtcgagttctattccgatcatcaatcctttccttcggatggatttaatatgtggtaaatctttaatttcattttcaatatactcacccatttcctgagcatttttgataagattttcatctttcatcacatccagcacagcaatggaagcagcgcaggcaaggtgattcccgccaaatgtagttcccagcaaaccgttacttgcctggaattttggatggatcaaaactccgcctacaggaaatccgtttcccattccttttgccgtagtaatgatatctgcttcaactccaaattcctgatgggcaaagaaatatccgcttcttccatatccggactgcacttcatccaaaataagaacggcgtcatacttttcgcacagttctttgattttagataaaaattccggtgttggaatcataatacctcctactccctgaattccttcgatgatcacagaagaaatttcatttccagacttctcaaaagtctcttcaagctgctgtacatcattccattctgatttgataaatctttcggaaaagttaaccggagctacaatttttggattatcagtcactgaaaccgccgcagaagttctcccatggaatgaacctgagaaatacaacactttgcttttcccattatgaaatgaagccagttttaaagcattttcattcgcttcagccccggaattacataagaaaagattataatcttcatacccggaaagctttcctagtttttctgccagctcagtctgtaattcattctgaacagagttggaatagaaagatattttttccagctgatctttaagcttattctgataatatggatggttgtggccgatagaaattacagcatgacctccgtaaaaatcgagatatttctctcctttatcatcccaaagaaatgatccctgagcttttaccggattgatattgaataatggatatacgttgaataaattcatgtcttttttataaatgataattgataaataatgaatggtatgggattaggatttcaagttcctacacatccatctactttccatattaaaatgctaccggtttcaggttcagtcctgcattttcttcccagttcatggccagattcatattctgtacggcctgccccgatgcaccttttaacaaattgtcaatcgctgagtgaataacgacaacatttccactcttttcgatctgaatcacacagcgatttgtattgacaacctgctttaaatcaactgccttcctgcttaccgtaacgaaaggctcctccgcataaaaatcctgatacaattgttctatttcctccagctctaaatccgtcttcatcgtggaacttgtaaaaattcctcttgcaaaatctcctctccatggaacaaaattcaggtttacttctttattattgaatgaaatcagctgctgcaaaatctcatctacatgctgatgagttaatgttttgtatgctgaaacattatcatttctccaggtaaaatgagttgtagcctgcaaggactgtccggctcctgtagaacctgtaatccctgtggtaaaaacctcatttaacagtcctttttctgccaatggcaataaggccaattgaattgctgttgcaaagcatcccgggttggcaatgcttttggcagttgccagttgttttttattgatttccggtaatccgtagataaaatctctgtttccgaaatttccttctaaacggaaatcgtttccaagatcaataaccagcgtttcctctttaacaggattctgcgttaaccagttttgactttctttatgaggcagacacagaaaaagaatatctacatcttcaggtttatctgttaaaatcatttcacagaccgtcgttaaatccgggtacagatccgaaatgcttgttcccgaattcgaacgactatataaaaaactcaatgtcacatggggatgaaaagccagtaagcgtatcagctcacttcctgtataaccgttggcaccaataattcctactgttttcttcattttgattctgacagaattttgttctgcctttcattaaatcgtcccttcggaactagttgatattctggttaatctggtggtatatatttaaagaattgcttacaatcttagtatacccttttacatcatcgcctgtccatgctctgttggcttctccataacttccgaatttatcggacatcaggtcatgatcagattcaattccattcaaaataaatctgtatggatgaagggttacaaatactttcccgcttaccgttttctgagaatctgtaaggaaagactctatatttctcatcacaggatctaagaaaagtgcttcgtgaagccagtttccataccaatcagataactgcgacttcatcatttgctgatattttgaaagcgtatgcttttccaataaatgatgcgctttaatgatcaccgatgctgctgcagcttcaaaacctacccgtcctttaattccgacaatagtatctcctacgtggatatcacggccgattccatatgctgatgccagttcttctattttttgaatagcatatacagaatgttcaaaactttctccattcacagcaactacctcaccttttttaaactcaatctccagttctgaaggctgagtttctttgatctgagaaggaaaagcttcttctggaaggcaatttcttgaagtcaatgtttcttttcctcccacagaagttccccaaagtcctttattgacagaatattgcgctttctggaattccatttcataaccatgttccttcaaaaactcaatctcttcctcacgggataatgccatatcacggataggcgtaatgatttcgatattcggacacattacctggaagatcaggtcaaaacgaacctggtcatttccggctcctgtactgccgtgagcaatagcatctgcctgtacttcaatggcatattttgcaatctcctgcgcctgaatggtacgctcagcacttacagaaagtggataggtattatttttcagtacattcccgaaaatcaaatatttcacacatgaattataatagtcttcctgagcgtctacacacctgtattcttttactccaaggtttaaagcttttctttccaactctttttcttcttcttttgaaaaacctccggtatttacagtgactgcatacacatcatatcccagtgtctcactaagatatttagcacagtaggaagtatctaaacctccgctaaacgctaagatgactttctttttcatctggattttttttatttttattaattgccgcattgaattccccaacagtatcctgtacagaatatttaaaatctgcagggttcatttcattatatttattttcagggcggtcatttaccgcctcattcttttttatattgtcaggaacaaacaacatcgctgtacataaacagtttttacgttccttcatcatcaggatttcatagttcacacagttcttgcagccgttccagaattcctcatcctgagtcagttccgaatagatcactggtttatatcccagatcactattaattttcattactgccaaacctgttgttaatccaaatactttcgcatcaggatatttatctctagataactggaaaactttctgcttgatctgagtcgctactcccccgttcctgaatttcggcgacacaatcagtcccgaattggccacaaacttcccatgtgaccaggtctctatataacagaaacctacccactcaccgttttcagtagcaaccacagcattgccttctgaaatcttcttgctcaaatattctatggaacgttttgcgattcccgttcctctacgctgtgcagaatcatacatttcctgctgtatttcactcacatacattagatgttcgcatgaggaaatttctatttccatttatttatctaaattttttggcaaatttaaaatataatttcttttatatccaaataaaaaagatattttttttgttttaaaattttagacaggtaaaattatctttaaacaaaattatacatttgctaatttattatatatttgctaaaataatatagttatggaaaatacctgtccaagatgcaagagtaccaaagtggtaaaaagcggcattgtcaatgacaaacaacgcttttactgcaaagactgcaattattattttaccgttaaaaaactggggaaacaaattgatgactactatgtcaccaaagctcttcagctttatcttgaaggcttaagctaccgtgaaattgaaagaatcatcggagtttctcatgttaccataagctcatggattaaaaaatacaacattacccgacctccacactctgaattccatcctgtctataaaatattaaagcagaatgaactgatcgactatattgctcaggaagaaaacattaaaaattccgggattatcatcacccaatttgctgataagtatatgctgatcaagtgggaaaggtttaagaagtagagagggatgcgagattcggattacgggttacgggtgagagacaccagacccaaagcacaatacaatattaaatatcaaccacttacaaacaatttaaattaaaaccccggatcacaaaacccgaaacttataacataacatcaattataactataccattaccaataatatatattaaattttcataaacaaattattaattacaatttggcattcataaaaaacaacgccaaaaattgataatttatgaagaaattacttacatttattggagtagccttaatcagcagttctctatactcacaaggttctcctgattatggcagtggcttaaaaatcaaccttaatcctgatggtgataaatttgtcagatttattttatgggaccagctttggttaagaaacacttccatgaacccgggaagtatggtaggcggtgaacctacagacaattcctggagcataggaaacagacgattacgtgctcttacctacgcacagatttctaaaagatacatgattcttcttcactttggaatcaataaccagacctttatcaatggcggagctacaggcacttccgggacaggaggttacggaaacggaaagaaaacccagctgttttttcatgatgcctggaacgaatatgcagttattttacctggagaagcgggaaaattcagtttatctttaggagcagggcttcattactacatgggactttcccgcatgaccatggcttctacccttaatttcctcacattggattcccccgttttttcatggccgttaattgataattccgatcagtttgcaaggcagcttggaatgttcgccaaagggaaatacggaaaactcgaataccgctttagcttaaataaaccatttgctacggatctcgttcctgtgaacgtgacagatccttcaaaagcagtagccgtagacaataacggaaatccaagtttttcaaaagcaggatatgttgagtatcaatttcttgacgaagaatccaacactcttccttttaaagtaggatcttaccttggaacaaagaaagtctttaatgtaggcgccggtttttatcaccaggctgacggcacaaggacttccgtcaattcaaatattgaaaagcatgacattactctttttgctgtagatgcgtttgcagatattcctttgggtgaggcaaaaaacaaaatggctgtttctgcctatgccggatattataattacaatttcggacccaattatgtaagaaatctgggaacaatgaatattgcagcatctgatcctaattttatcgggaataaagccatcgcaggacctggaaatctgcaaccgaccatcgggacaggtaatattatctacgcacaggcaggtttactcttaccaagtcaggcagaaaagccaaagatcagaatacagccttttgcggcatatactcacaaaaactttgaggcttttgataaatcatcctcccagtttgatgtcggtgccaattggtttatagacggacatcatgcgaaaataacaacacaatattcaacaagaccggtttacacaagtcctacggaaagcccatcttcaaaaggagaattcattgtacagtttcaaatctacctttaaaatttgaaccattaagaatagtaaaaaatttaagataagttaagctctatcaaagatggatagcaagaataccgctgaataaaatagctttagctatcatctcaaattattcttatcaacttaaaatcccttaatagtttaaaacaaattaaattcctattccactaacatcaaaaactaatcaatatgagcgaaaatcatcacgaaagctacgaaaatatgaccgacaggcagaaaaaccgcaccatctggagcgttatcacagcctcatccctcggtacactgatagaatggtatgacttttacatcttcggaagtcttgccgttgtcttagcgaccaaatttttccctgcagacaatcctacagccgcattcttatctactcttgcaacttttgctgccggatttgtagtaagacctttcggggctttatttttcgggagactgggagatcttatcggaagaaaatatactttccttgtgacactgctgatcatgggtttttccactttcctgatcggttgtattccgagttatgaaaccattgggtttctggcacctgtcttagttttaattttaagattgcttcaggggcttgctcttggaggtgaatatggaggtgctgctacttacgttgcagaatacgcgcaacctcatcgaagaggttactggacgtcatggatccagactactgcaacagcaggactttttatatcattaattgttattctcattaccaaaacaacactttccgcagaagaatttgacacctggggatggagagttcctttctggatttccattctgatggttgccgtgtcttacatcatcagaaagaacatgaaagagtctccgctttttgcgaaagctaaaagcgagggaaaaacgtctaaaaatcctttaaaggaaagtttcggaaataaatataacttcaagtttgtattattggctttattcggagctgcgatgggacaaggggtaatctggtatacaggacagttctacgccatgagtttccttcagaaagtaatgaatgtagaatctgctcaggtagattcattaatggctaccgctttattcttaggaacgcctttctttgtctttttcggatggttgtctgataaaatcggaaggaaagcagtaatgatgaccggcatgctggttgccattttagcgtacaggcctatttatgacagcatgttcaaaagcgtgagccttgaaaataaaacggttgcttccaatggaattactgaaaaaagaacagcaaaaatccataacgatattgcaacagacagcctggttactttccacaaggaaaccctttatacagacggaaccctgatcaaaaaagacagtgtagttcactggtcaccttcaggagttgtgatgaaagacggaaaagctgaagagcctaaagtttcccaaagcttacaattaagtgacaataccaaatggtacctggtctttcttgtattcatccaggtaatatttgtaaccatggtatacggacctatcgcagctttccttgttgaaatgttccctgtgagaatccgatacacctcaatgtcgctaccttaccatatcggaaatggagttttcggaggccttcttccggcagtggcaacttatcttgtaaccaccggaaaagaagcagggcatgcaacatggtatcttgaaggattatggtatcctatcggagtggctacagtatgtctcatcatcggattgttttatcttaaaaataagaacaataatcttcacgattaagtactgaataactcaaatttttattaattttaaaactactaaaatgaacggactaaaaaaaatattaggcattctctggatcgccattgctgtaattgtaggatatttcggaattaccgtattgggaattccgaaaataacctccggaaagcaggaagatctggtttttggcatcattattctttttgtgctgatgccgattatctctggcggaatggcagtttttggatattatgccttaaaaggagaatattctgacgacaaaatttaaagcaatataaaaaaacagataattgatggatgccacattcatcaattatcttttatcaaagaatcatttatgaaaaaaagacacgaacaaaaacttatcatactgagcatagggcttatgattgctttcagtattcctgtttcactgcttttcaatagtgacagggaggttttgggctatcctatgattcttatttatatgttcgtggtatggatgatttccattatcatttcttttgtaattgtaaaaaggtatgatgagtagttttgccttattttttgtggttttgttttatctggctcttctgttcttagttgcttatttagcagagaagaaaagaagtaagatctggatcaacaacccttatatttatgctttgtctcttgccgtttattgtactgcctggacgtattatggaagcataggcgttgcagcaacaagcggattaaattaccttccgatctacattggccctatcatgattattccggcatggatctatatcaacacccggattgtaagaatttcaagggtcaacaaaataagcagccttgccgattttatttcgttgagatacgggaacagcagaagcctgagtgctattatcacggtggtttgtctgctggccattgttccttatatcggactgcagatcaaagctatttctgaaaccttccatctggtaacggaaactccgatgtctaatgatatcctgaccgataatgcaacttttgtggtagttttaattgctttgttttcatcttattacggaacaagatatgtggatgcttcagaaaaaagacttggcattatctcagcaattgcattggaaagctttttaaaattattttttatcatcattctcggtttttttgtcatttattatgtctttgacggattctcagacatttatgagaaagcaagtaagtttgcagattttaaagaaaaaaatacctttaacggaattgaaggtgccatgaactggatggttctttgtatgatttccgctacagccatatgcattttaccaagacagtttcacactgcgattgttgaaaacagacaggaaaagcacatcagaacagccatttggtttttcccgctttatcttttgatcttcaccgtatttatttttcccattgcctggggtggcagattgatttttgacggacaaaaagtaaatcctgagttctactctattttgattccacagcattttgacaacaccttaatcacggtatttgtatttctgggaggactgagttcatgtatttccatgattattatttctgctattactttatccattatgctttccaacaacctcatcattccatacggattgctgggaaaactaaagtctgaaaatgaggaacaaaataccagaagcattaccaatatcaggaaattcagcattttcgctttgatcatcatggcttttgctttctataaatatttcattctgaaaacttcactggattctgtaggattgatctcctttgtggtcattgcacagctggctccggcatttttcggggctctattctggagaagaggaagttataaaggcgctgttacaggtcttatagcgggattaataatctgttatttcggattgattattcctcagtattatttttcttacaaccaggaattcaaaggagtgctgagagatatgtataatgctttcggttttttcacaattccttatctgggaagaatcccgcagatctttttctggtcgatgctcgtaaataccggcttgtttactattatttccgtaagctcaaaaggaaattaccgagaaaggaactttgctgaactctacgttgatattgacaaatatattcagaatcatgaaaatgctttcatctggcgcggaacagcctatatttcagatatccggaatattcttgagcgttttttaggcaaaaataaaacagaacaggcactaagaatttttaatttaaaatataacatcgactctaatacggagactgctgattcaaggtttatcaaattctcagaaaaccttttagcgggaagaatcggaactgcttccgcaaaaatattgattgaaggtgtgaccaaagaagataaaatatccttaaaagaagtactgaatatccttgaagaatccaaagaaaatatcaccttaaataaaaaacttacagaacagtctgaagaactgcagaaactttctgatgacttaagaaatgccaacgaaagtcttatcatcaaagaccgccagaaagatgatttcctggattccgttgcccatgagctgaggaccccgattacagccatccgctctgcaggagaaattttagcggacgacgatgatattccttttgacattaaacaggaatttttaaacaacatcattacagaatctgacagattaagcgaaatcatcaacgatattctttaccttgacaaactgcaacatggtgaaatctctttacatattcaggaaaacaatattcttgaaacgtataaaaaagcattaaatccgcttcttcacctgatacagcagaaaaacattcatttaagcgaagtaaatctcctgaatcagtttatatttgaatatgatgaagcgagaatgattcaattgtttcagaatatctggggaaatgctttaaaatttacagatgaacaaggcaccatccagaccaagttatttgaaaaagatgaacagctcgtgattaccattttcaataccgggaagcatattccggaagaggatctggaaatgatttttgacaagttttatcagtcaaagaatcagaatattttaaaacctacgggaagcggactgggactggccatttccaaaaagatagtacaggcacttggaggaagtataaaagccgaaaacagcggactgggcgtaactttcaccataagcattcccaaaaaaactaaaaaagagattataaatgaagttgaacaccattaaaacctttttatgagaaagatcattattgcggatgacgaacacaaaatattaatgtcgctggaatacagctttaagaaaaacggatatgacgtttatattgccagagacggcacagaagttctcgactttttgaaaacaatgattccggacgtcattcttcttgatattatgatgccgaaccttgacggatacagcactttggatattatcagacaggatgaaaaactgaaagacaccaaagtgatctttctgagcgccaaaaataatcccagagacattgaaaaaggactggaaatgggcgcagatgcttacgtcacaaaaccgtactccatcaaaaaactgatgcagcagattgaggagatgttttagattgcttcccctccagccggcaatgacacagcttaaccaaacacaagattattgacatgaaaacagataccttatttaaacaaagcatagaaaataaagaagacttctggagagaacaggcaggaaaaatacaatggtttgaatttccccaacagatcctttcaaaagacgaaaatgattacccacagtggttttctgatggaaaacttaacatgtgctacttatgtatcgataaacatattgaagacggatttggagatcagattgccatcgtttatgattcccctgttaccagccaaaagaaaacctacactttcaatcaggcaaaagaggaaattgcaaagctggctggcggattgatttctttaggattaaaaaaaggagatacagccgttatttatatgcccatgattccgcagacgctttttgccatgctggcgtgtgcaagaatcggagtcattcataatgtggttttcggaggcttcgctccccacgagcttgtggtaagaattgatgactgcaaacctaaagttttaatcactgctacagccggtgtggaaattgccaaaagaattccttacctgccactggtagaaaaagcgattgagctggctcaggataaagtagacaatatcgttgtatacaatagaagattagtggataatcaggatgaaatgtttgacgggcttatagattatgaagaactggtagaaaaatcagcttcggcagaatgtgtttctgtagaatctgcccatccgctttacctgctttacacgtcaggtactaccggaaagcccaaaggtattgttcgtgataccggaggatatgccactgcattgcaattctcaatgacctatgtgtatggtgttgagccgggagaaacctattgggctgcttcagacttcggctgggctgtaggacatagcttttcggtgtacggaccattaatcaacagaaacacaagcatcattttcgaaggaaagcctgtcatgactcctgatgccggaactttctggagaattatctcagaatataaagtttcggtgatgtttacggcacctactgcgatcagagctataaaaaaagaagacccgaacggggaactggtaaaaaaatacgatttaacccacttcagaaaacagtttcttgcaggcgaaagatgtgatgtagccactttggactggtttgcagagcatattggtgttccggcaatagatcattggtggcagacagaatccggatggcctatgcttggattgctgactcatgatgaaaattatcagatcaaaagggcatctgccggaaaacctgttcccggatatgatattaaaatctttgatgaaaatggctttgaactggatgctcaccatgaaggttatcttgtgatcaagcttcctctcccacccggcgccatgcttggaatctggaaagactatgaccgttttgaaagcagctacctttctcagtataaaggctattatttctcaggagacggcgccatacaggatgaggacggctatattttcattacaggacgagtggatgacgtaatcaacgtggcaggacacagactttccacttctgaaatggaagaaatcgtttcttcacatccggacgttgccgaatgcgctgtagtaggtattgatgatgatttaaaagggcaggttccttttgcgacaatagttctaaaaaacggctcagctatttccgaagaagacatagagagagacattattcagatggtccgaaacaaaatcggagcggtagcttttcttaaaaatgccatggttgtcaaacgattaccaaaaaccaggtcaggaaagattttgagaaagctgatcaggacgttactggatggcaaagattttcagattccatcaacgattgatgatgaaaaaatcattgatgaaattcaggaaaaaatcaaagaatatagggcttaaacgggaaattaaacataaatttaaaatataataaattcaaatttcaaaaaacgaaagggatatgagaaattacttgatagaagatttaccacaatattttgaagactataaaaaatctatcaaaaacccaaaaaaattctgggataaggtagcggatcagaatttcgtgtggtaccagcgatggagcaaggttgttaagtacgatatgaatgaagccaaaatcacatggtttaaaaatgcaaagctcaatattaccaaaaactgtatcgacaggcatctggctataagaggcgataaaacggctatcatctgggaacccaatgatcccaaagaagaagcacaacacatttcttacaacgaactctatacacgtgtcaataaaacagccaatgtgcttcgtgacatgggtattgaaaaaggagacagagtctgcatttaccttcccatgatccctgaacttgccattacgatgcttgcctgcgccaaactgggtgctgtccattctgttatttttgcaggattctcagcttcagcagtagcttccagagtgaatgactgtgaagcgaaaatggtcattacttctgatggaagctatagaggaaataaagttcttgatcttaaaagcatagtagatgatgcattagaaaagacaccaactgttgaaagtgttcttgtagtaaaaagaacccacaatgaaattaagatgaaggaaggaagagatcactggatggctgatttgtatgaaaaagcgtctcctgatttcgtcactgtaatcatggattccgaagatccactcttcattctatatacttccggatctacaggaaaaccaaaaggaatgcttcatacctgcgccggctatatggtgtacaccgcttatacctttaaaaatgtattcaattataaggaaaatgatatttattggtgtactgcggatatcggatggattaccggacattcttatatcctttacggacctttattaaatggagcaacaaccgtaattttcgaaggggttcccacttatcctgaaccggatcgtttctgggaagtaattgaaaagcataagatcactcagttttataccgctcctaccgccatccgttctttagcaaaagagagtgcagaatgggtagataagcatgaccttagttcccttaaagtaataggttctgtgggtgaacctatcaatgacgaagcatggcattggttcaatgatcacgtcggaagaaaaaaatgcccgattgtagacacctggtggcaaacagaaacaggaggtattatgatttcaccgcttccttttgtgacccccaccaaacctacctatgctacccttccattaccaggtgtgcagcctgtcctgatggatgataaacgaaatgaaattacaggtaaccaggtaaccggaaatctttgcatccgttttccatggccgggcatcgcaagaactatctggggagaccatcaaagatataaagaaacgtacttcacagcctttcctggaaaatattttaccggagacggtgcattaagggatgaagttggttattacagaattaccggacgtgtagatgatgtgatcatcgtttcaggacacaaccttgggactgctcctattgaagacagcatcaaccagcaccctgccgttgcagaatccgctatcgtaggctatcctcacgatatcaaaggaaatgcactgtatggatatgtaatgcttaaagaaacaggggaaagccgtgataaggaaaacctgaagaaagaaattaaccagctgatttcagatcagatcggcccgattgccaagctggacaagatacagtttgtttccggccttccgaaaacgcgttccggaaagattatgcgtaggattctgagaaaaattgcagaaggtgacttcagtaatttcggagatatcaccactcttttgaatcctgaaattgtagaggaaattaaaaacgaaagaatttaattaatcattatttaaccaatagtgggccctgggagctatttccggggcttttgtttatggataaaataaagtaagcctaactacctcgctcttccccctacctcacgtaaatcttgtaacttaataacgtagatttcattatttttatatcatgaacacaactaaatttaattcaatcaaaaacgtttaaacaattaaattcaattagagaacaataatgaaaagaattaatataagagcaattacatatttattgatattttgtggaattatcttagtgattgattttatatatagtcttacagtttctcaccatttaacatcagctagtttaatatttgatactatttttggttttttattttggatattatttattttttctggtaaattaaaaaaataatgctttagaatttccctttactacactgggaattaaatatgataataaggctactttgaatcttcaaataatttaatgatagatactctaaagacacatagataactccataacagagaactaatgctataaaattagtaaaagcacaatagccaaaaccagataatgaaaacatttaataaaataataatttcttgcttctttctttttataggttgttcgactgtaaagatatctgaaatatatggtacagagatggagattgttgaaaatgtacgctcacaagtcctgatcaaaaaatttaatgcacaggataaaaataaatcatttttaatttttgctgatgaatttgacaatcttataaccgttaaaaatggagatagcttagttcttgataaaaaaagtaagactatgccaatgttaggatttacaactgcttgtgtaatttttaataatagaaatgttacaattatggttgacaataaacagactgtaaaactaaataaagaccaattatcaaaatataagtttgtatacgttgaaaaagataagaatcattatcaaattgaatacaccaacaaagcaaagtcttttcaataaaatatcacttttatagcattaccacgtgaatcatttcgcatgaaagataatagaaaatcctgatcaagcagggcagtctttgcttatcttctagagtaactacgttttttagcaaaaaaatctttcaacaatttttacaatcaacttatcattttgtattcttctcaaatagaataagttaaaaaataaataatttttacaacacaatattatccaatcactaaaattaaacacccgttcaataattattttcaaacattatcaatatctattaaaaaccaaatattaattaacaaattttattggatcaaatacaatgataatcggaaaattattagtaactttaatggtaacttaaaaccaattaactatgtcaaatatattagctggactatttgagcatcacagcgactacaaaaaattagagggtgatctggaaaattcaggatttggaaatgaagattacattatataccttaatagtgattctaataattcacaatacctggcaagtgttacggtaaaagataatacacagattgaccttgcacggaatgtatttattcagaatgcggccctgaaatcatacttatttgaaaatatgagcatcagtgaaacaaattatgatacgatcaaaaaatatattgacgcaagaaacagagcagaaattcataacagtcctgacattaagattaaaacatcaagcgacgggatgaattctgaagtaaaattctaatcatataaaaacttgataaccggagatccgcagtgtatgctgcggatcttttatgtttgaaaaaagtaaaaaaattcgtattttcgtctaattataggcatgtgcacaaatgagttacgatttagaacaagagaataaggaaatccttgcaagatataaggatctgatttctaacacatacagaacgttggatgaggaaaataataagctcatccgaaaggcattcgatatcgctctggacgctcacaaggatcaaaggagaaaatccggggaaccttacatctaccaccctattgctgttgctaaaattgtagcgacagaaattggtctgggtgcaacttctattgcctgtgcgcttttgcatgatgtgattgaagactctgattatacctacgaagatctgaagaaaatctttggagaaaagattgccaatatcgtgaatggactgaccaagatttccatcatgaatcatcagaatatttctgtgcagtctgaaaactacagaaaactgttattgaccttatccgaagacttcagggtgattctgattaaaattgcagaccgcctccacaatatgcggactctggagagtatggccccggacaaacagaaaaaaatcgcttctgaaacggtttatatctatgctccgatggctcaccgtcttggtttgtataacatcaaatctgagctggaagatctttctttaaaatataacaatcctgaagtatataacgaaatcacggaaaaattggaattagccaaagaaagccgtgaaagatatatcgaagagttcaagaaagaagtatccgaaagattacatgaagaaggtttaaactttaaaatcaaaggccgcgcaaaagccatttcctctatttacaggaaaatgctgaagcagggagtttcctttgaagaagtttttgacaattatgccatcagaattatttataaatcggatgctaaaaatgaaaaattccttgcctggaagatctactccatcgttacagatgtataccacagtaacccttccagaatgcgtgactggattacccagccccgctccactggatatgaaagtttacatttaacggtcttaggccctgacaaaaagtggattgaagtacagatccgttctgaaagaatggatgaaatcgctgaaaaaggagttgccgcacactataaatacaaagagggttacaaacagagttccgatgacagaaactttgaaaaatgggtaaccgagatccgtgaagtactggaacaacagcaaaatctttccacttccgaacttttggataatattaagcttaacttatattccaaagaggtatttgtctttacaccaaaaggagagattaaaattcttcctaccaatgctacagctctggatttcgccttctctgttcactccgatctgggaatgaaatgtttaggagctaaaatcaatggtaagctggtgcctatttcctatatccttcaaaacggagatcaggtagatatcctttcctctcagaatcagaaaccaaaatctgactggctggaatttgtggtgacctcaaaagcaaaatccaaaatcaagagttacctgaattctcagaaaaatcagcttgtagaagaaggaaaagaaatcctgcagcgaaagctccgtcatgcgaaaatcaatttcaatgatgaagaaattaataagctgcaaaagttcttcaatttaaaatcatctcaggaactgttccttaaattccaaagcaatgagctggatgtcagcagcctgagaagatatatagaaagtaaaaacgtattcaataatttactttcaagattcagaaaatcacctaataaaagccaccatttcgaggaacccaaagaggaaaaccttgatatgattgtctttgggaaggatgaagagaaacttaattacagctacgcaaaatgctgtaccgtaattccgggagataaaattttcggatttatcaccatttcagatggaattaaggtacacagtgacaactgcccgaatgccattaatctgagagcccagtatgactaccgtgttattcctgctaaatgggtgaatgcggaaagcttcaaaaacagggtaaaaattgagattgaaggtctggacagaatggggatgattaatgatatcacaacggtcatcagcggaagcatgggaatggatatgaaaagtatgtccattgaatccaataacggtgttttcacaggaaatatcaatctggaagtcaaaaataaaggtcagctcgaagagacctttagaaaacttaaaagtattaatggtgtttccagagtgagacgactacaatcataacatgaatttatctctttactttaaaaaatttttcaacaacagtcagtcatcaggaattattctaattttctgtgtacttatttcattgattattgccaactcctctgcagcagaaaattttcagcaatttttagacaaagaatttggcacccatcttttcgggcttgaatatcctgtcagcatctggatcaatgacgggttgatggctatattctttcttctggtaggccttgaaataaaacgggaacttatagaaggagaactttcatcctttaaaaatgcctccctgcccatttttgcagcagtaggcggaatgcttgtcccggcggtaatttacagcattttcaataccggaacagaatacagcaacggctggggaattcctatggcaacagatattgctttctctttggcgatcatttcaatgctgggtaaaaagattccgaattctatcaaaatatttttagcggcactggctattgtagatgatctgggagctattctcgtgattgccattttctatactgagcagattcactggagttatcttctgttatcttttggagtaacggccttactttttatcttaaactttttaaaagtaaccagaatcatattttatattattccgggactgtttttatggtacttcctccatcattccggaattcacgccactatagcaggtgttttacttgcattttcaattcctaccaatgcttccaacgtagaaatatcacctttggaaaaactggagcatcagctccatattccggtaagttttcttattatgccggtatttgcactaacaaataccaatatcactttttccagcgaaatggtgacgggagttacaagtacattaggattgggaattatctgcggactggtattgggcaaacttcttggcatcaatttattctcattgattgccatcagattaaagcttagttccctaccccagaacagcaattggctgcagatgattggtgtaggtctgctggctggtattggatttacaatgtccatttttattgcattgctctccttcaaagaagagattccgattcaggacgaagctaagtttgccattctgattgcttcctttattgctgcaattgccggatttaccatcctgagcataagttcaaaagaaaatcctgaactggaggaaaattaatctttcttccggttctccagctttcttttatgttcctcatcaccatcaaaatccggctcagtaacctgtgcatgatattctgaggcttctttgcggatttcatctgacagcagcttttctattctgagttttctgattgccatattcagctcattcccgaataaaagaagatacacatttacattcacccataccatcagcaggatcatacttcctatggacccgtaaagaacgttataccgtgcaatatcctttacataaatggcaaaaatataagttgtcaccacaaacagtacagtagtcaggattgcccccggaaccgcctgacggaatcttgtgattttcactgttcccagccagtaaaacaatgtcagaagtataaagtaaaaaagcgggaaagaaacgaaaccgataatcttggaaaggttatctacaagccaggtaatttcataagccggcataaaaggcctcataacaacctccgcatagtaaacgccaaagagggcgagaaacacgatggtaataaagccaattgtaataaaaaaggaaagaatgaattcttttacatcgctcagcttttcatccgaattctcattgaaaccattgatcagggaaaaagttccgtttgttgcaaaaagtaaagccagcaaaatggtcagattactgatccctttcatattgggaacaatattggcctcaatatatcctcgtatatccccttccatattagaaggaaaaacattgtgcatcaatacttcaaaaatataaaactgcagcttggcataatgcggcatataaggcaaaaccgaaagcaggaagagaataaacggaaacagacttatcgtaaagctccacgaaatagcagcggcttttcttcctattttccctttaaaaattccggagatataaatctgaaacatctgccaaagcgatattcccaaaacaggaatatggatgctgtcgaaaaactcttgaatctttaaaataaatttaggaacctttacactcatcgatctgtttgtctttgatacaaaggtaggggaattaaattaaatgggaaaagatagaaggtaataggtagcaggaatcagggaatttagagttcaaagtttaatgttcaaggctagcgtttaaagctatgagttaatcagtaacaaaaacaaaaccgaatcacgcaacccggaactccacaacaaaacaatcaacaactttgatcttccccttttaaagccctatctttgcagcctgaaacatcttacaatgcgaatcagcttactttgtatcggtaaaacagatgataaggaaattacctctttgatcagttattaccttaaccgcctgcccaaacactggaattttgaaatcattgaaattccagatgtaaaaaatgctaagaacctgtctcccgaccttcttaaaaaagaagaagctaaattatttttaaatcatattgataaaaacgatctggttgtcattcttgatgagaaagggaaacagtttaccagccgggaattttcagcaaagattgatgtatggatgaattcttcagtcaaaaaaatacatattctgattggaggtgcttacggcttttctgaggaaatctacaacagagccaatgaaaaaatgtctttatccaaaatgacttttacccatcagatgatccgtctgtttattgtggagcagctttaccgtgcagatcagattttgcagggaaaaccttatcataacgattaaaagaaaataggctctcaagaatgtcattctgacgaaggaagaatctcaccaatacaatttctgagattcttcacaacattttattcgtttagaatgacaaagccaaataatttgacttttctctatttcaggctgagctgcctctttgcttcacctatgacaaaagcaacggaattggcaatattaaaactcctgataagttttgacataggaatggtcagatgattatcaaaacggtccagaacatctttactcagccctgcactctcctttccgaaaaccagccagtccccatcctggaaatcagtttccagataggatttttcagcatgtgagctcattaaaaaaacacgtgacctatcaggaacagtttcaatccattcttctacatctgcatattctgaaacatcaaggtgtacccaataatcaagtccggaacgcttcaggtttttatcattaattacaaatccaaatggatgtaccaggtgcaatctgctttccgtccccacacacaatcttccgatattccctgtattattaggtatttcgggttctacaagaacaatattcaacatctttctattcttaattctttttttaacagttacaccagtttggttttagtatggattaattaaatgattgggaaggatcagttttctgttatttttttgcacatttagcgtaaaaatcagtcagcaccgctttttcatatcccaaagcaactgctttgtcaagattttcgcaggcttcttttggcttggaagtatcaaacaaaatcatagccttgcttacataagactgcgaaaatttcgggtctatagaaatagctttattggcatcggccagcgcctccttgtattttttcattttaaaataaacatctgcccgcccgttatatagcaatgattccggtttttcagcaagaagctgattataatcttttaaagctccatccagatcaccattattttttttcagattggcaagccctgtttttgcaaaaatattgtccggagcaaaagtcagaatctggttaagatctttaatcgcaagatcttcttttccctggctgtcgtagattttggaacgggtaagatataaatctgctgtttcaggatttactttgagtcctttctctatatattccagggctttcactttgtttcctttctggctgtaaagtgatgacagattgacgtatacagaaactgccaaagggtttgctttcagagcagaatcataagatttaaaagcctgagtggttttcccaagccttctctgtgctgttcccagataatcgtaatattctgattgaaatttctggatctgttctttctctgccagttttaagtattgctcttcggcacacttataatcagcttttttaaaacattcttcagccagttttttatcctgggcatagaaattaagagaaaaacagagggaagttactaataataaagtttttttcatgaagttatagtttgtttgttgatcacttttttggcgagtgcaccaaatatcactcccaataaagatccaacaaacgcccccaccaaaatatctatcgggaaatgcacacctaaatatatacggctgtaggaaactaccacagcccatacaaatatagcatatggaaaccatttaagcttattttttaataaaatacttaaaaaggaagctaaaaagaatgtatttgaagcatgggcagaataaaagccatactgtccgccgcatttcacgattctcatgtgatgttccagagtggggtcatgacaaggtctgagtcttgccacaccatatttgaagacaccggccagctggtcagaaaccgttgcgccaattgccagaaatataaggataaaaactaacgatcttagtttatagtttttgtataaaaaataaagaaatataatataaaggggcacccagatccaggtacttgaaatcagcatccaaaactggtcaaaagatgaattgcccaaattattaaggtagagaaatacctttttatcttcctgaatgatttcctccatcgttatctgcttacaggtccttcgtaagtctcatcatctgcaggttttggttttggaggctcattagaagcaacagaagagggctccgtaagaatatcttttttgatatcattcacaggattgaaatctttggcagcatctttcaccttctcaatttcacgcttgatttcagaaacaggattatctgtttccttcatgatttcagttttgatatcttctaccgctccacgcatttttctaacgcctgcacctaagtcacgcgcaatctgaggcagtttatccggaccgaataatacaacgattgcaatggcaatgagtgccatttctccaatgcttaattccatgcggtaaaattacgaaagattattccatttacagactgtaaactaaaaatttaaacaaattttaagattttatatcagggttcaatgtttaaggtttaaagttgctgactgtattttacgggttacggtttgcgtgatccgggtttgttttgttgctggctgactgataaccttaaacgctagccttgaactttaaactttaaaccttaaaccttaaaccttgaactttaagctccctaccctctaattcctgctatctgccacctataaattaacaaatatttaattcaaaacaatgagaattaaataataattctgtatatttataacacacaaaccaataaatattaattatgaaaaaactagtgactacttttaaagttttcgccgtcttatcggtattaactctcaacagctgccggaatgaaagcagtgaaatgaaccagcaggaaacagttcagtcaaaggtaactgttgctgatctgaagaaggagattacttctcttccatctcaaattgtcccagaagcagttcagcaccaactggatgaatccggaaaaaaccttgaagcctatctgaaaaatgatttacagattacaggagtacatgtattgggtaaaatttcatcacagcaaggtgttgagctttccaaaaaactgatcacagataaagaccagtttattgcatcaggaaacatcatggatccttcttctgtaaaaatcgggaaaatcggagatctgtacgagggagaaaatctgacaacagcacaacagggattaaatgaagcaatcacagaagagctaaaagccggaatcaatgttatggaaataacatggaacagtaaaagcgggaaatttaccacattatgcttttatggtgattcaggtattgtctgggataatattttcggaggtcttgttatgatggatacgcgtggacattcagaagcatctgatgaagtttctaaagtagcttccaaatggtataaacagtggtggaccgctaactggttatggggatctaagagaggtgaagccggataccagattaccatttattattccggttctacagtgtccaatgcagatgtaagtgattggggttatatcagcttaggaaaagcgaaaagcgagagtaaaattacaaaaaggacaggtgcttacgggcaatgccgttatgcattgggactttgtactcctacaggttctttaagctttaattccactaatttttctgtatcattctccggattgggcagcaatatagtaagtaacgggacaaaatccctttatccataattctcataaaaatctgattaataaaaccgggaagcctttacaagcttcccggttttttataggttatattttctgatactaccatattctaacttttgatttcagggcttctattgcattttcctttaatccgaaagtattaaacagtatttcatacaactgaatatcattttctatcgttacagactctttcgcaccatcatcagacctgatgttcaggatgtgatccgtataagtataacgggcattctcatctacttttgagaggatcagcttattcttaaaatgcgaatccggatgtgtagacaggtaccaatttgaaatctcaagatcaataagctctacatgctcagggatgaagcgatataccggaagccattgctctttccacatccaaaggatatatgtattttctctgtgcgaaactttaaatattccgttgggtgtctgctgctgatcttcttcatttaaaagtattggagaagtaagtgtagcagttccaaatccacagtctacaacatactttttattttcaaaatcaacaataagcagtaaatgagtctgtgcagcaacgctgtcttcctgccttccccatactacccttcccagctgaagttttactttaaatcctaaatattttaaaacttcacttaaaagcaggttttgttcataacaatatcctcctcttgattcaacaaccagtttcttaaagacatcatctgcattcaaagaaggtactttccctgtataagggtctatattttcaaacgggatatgtttgggatgaagctgatgaattttcttcaatgtttccatattcatttccggaataccggagaaatgaatccgttcgagatactttttaaagtctgatgcattcataattttgtttttcctgtttcaaaattgagtaaaactacttcagtaaagttatcgaatagattgaacccaaagctataaatatattcagaatagaacagatctattatttctgaaagtctttttcggaggttacatcaaccagatcttttctttttttctgaaaagcagaataagtaatcacaacgctgagagccattaaaataaatgcaaggaaaaacggcgctcccgaaaacttgaatggtgcttcatcatgggtaaaaaagtaaaataaattcgtcatcatcggaggtcctataatggaggtggcactcattaaactcgttaatgctccctgaagttcgccctgttcgttggaaggaacacttttcgtgattacagactgtaaagccggtccgcagattcctcccaggcaatacggaatcagaaatacaaacatcatccagccttctgatgcaaaggcaaataacagcattcctactgcataaaaagccaatccgtaatagatacttttctgctctccaagcctaggagttgtccatctgataagaccaccctgtacaagccctaccaataaacctactactcctaacgaaatccctaccattctttctgtccagctgaatttatacatggtaaagaaactccagttactctgtaccgcatgtccagcaatataaattaagatcagtgaaacaatcaacccggaaatttcaggatgtttccctaaaaacttaaatgagccaataggattcgcacgcttccagtcgaactctcttcttttatctttatccagactttcaggaagaataaagtatccgtaaaggaaattaagcagacacaaacctgctgcagcatagaaaggaactctggcaccgtaatgcccgagaactccacccagaacaggtcctatgataaaacctaagccaaacgcagctcctatcagtccgaaatttttagctctgtcttcatccgtagaaatatctgcaatgtaagcactggcggtggttacacttgcaccggtaattccggcaataattcttcccataaacagccaccagatcgtaggcgctaatgcaaggaaaatataatctacggcaaatccgaaaagggaaatcaggataatgggtcttcgtccgtatttatcactcaaattaccgactaacggcgaaaatataaattgtgtaaatgcataggcaaatccaagccagccgccatattttgcggcttcactgatatctgcatgaataagttcttcaattaatttaggaacaacaggaatgatgattccccatcccgtaatatcaatcagtaaagtaataaatatgaagcctatagctgcttttttctttgaattttccatgatggtgcaaaattaatcaaatctgaaaaataatgattctaaattatgagcagcatatataaatactaaaaaatcaaatacataaaataatgacaaataatgcattacatttaaaaaagctttgtttttttcatatttcctgtttaacataaagaaaaaggccgttcctttcgaaacggcctttactaatttattgtagtttgtattactttgaaaccaattcttcttttgcagaagtggattttccatgtacctcttcttcttttcctgttttaaggaagtcgtaagcaattgcagatgcaacaaagatggatgaataagtaccgaaaccaataccgattaacatcgcaaacatgaatcctctcaggttatcaccaccgaaaatgaagatcgcaaggataaccagaatcgtagtgaatgaggtgttgaatgttctacccaatgtacttgaaatagagtcatcaaacagacctgccaatgttaaagattttttctctctcaggtattctctgattctgtcgaagataattaccgtatcgttaatagagtaacccaatactgtaaggattgcagcaatgaaatcctggttgatctccatgttgaaaggcatatacttgtgaagcaatgaatatgctcctaagataattaccgcatcgtggaacagagcagcaactgctccaagagagaactgccattttctgaatcttacaaggatatagatgaagatcatagctaatgcagccaataccgcataaataccgtgagtctggatatcatcagccactgaaggtcctactttctcagaagaaataattcctgcgtggtctttatcagcagatttgaaatctttcaatgttgttcctgccggtaactgtgattttaatccttcaaataatttttgctcgataatctggtcagcttttaaagattcatcctggataaggtaatccgtagagatctttaattgtttgttgtttccaaaagtcttagcttctactgaagagtttttaccatcttcagttttgaataatgccactaatttttcttcaacatcttcagctttcacatctttatcaaatcttaccacatagtttctacctcctgtaaagtcgataccgtatttgaaaccgtgcgttgcaattgaaatgatacaaacgatcgtaagtactgcagaaatgatgtaggcatattttctctttccaatgaaatcgatccatgtatttctgaataggttcttcgtagccggagtccatacagaaagaccttttcctttattcaatcttgagaagatcattactcttgaaagcaatacagatgtaaataaggtcattgcgataccaatcatcagcgtcaatgcgaaacctttgataggtcctgttccgaagaagaacaatacaactgccgtaaggaaagtcgtagtgtgaccgtcaataatcgcgttcaatgcatgtttgaaaccatctttgtaagcttcaagaatacttttcccggcgaataattcttcttttgttctttcataaatgataacgttcgtatccactgcaactgccatggtaagaacgatacctgcgatacctggaagcgtaagcgtaaagtctcccgaatccataataccgaaaatatagaataagttgatcaccattgcaattaccgcatatacaccagctccaccgtagtagaaaatgatataaacaatgataatagcaaatgcgatgatgaacgacattaaacctgaatcaatagcctcctgtcctaaagacggacctacaactgtagcctgaactacttttgcacctgcaggcaatttaccggcacccaacacgtctacaagctccttagcttcttcctgagagaagttaccggaaatctgtgttctaccgttaggaatagcgccaacaacgttcggagcggtatatactctgttatcaagagttactgcaaccggttttccaacgtttttctctgttaatgttttccactcttttgctcctttggaatccatctgcatgtctactactattctgcttagttcatcataaccgatgcttgcagtttcaacagcaccatctaccggagctttttgattgatattacctctgatcgcatacaataccaggctttcagtatcagtagcttcaggtttgtacccccacatgaactgtgtatatttaatgttagccggacgtaaagactgagctactttgctgttcaggattttgtttacaactgcagtatcagataattttacattagcaacaccattagttcttaatttgtcaagctgtaaaaggttcatgaagttcacattctttgcaactcccatagaatctccttttgcagcaaccatagttgtcaaagtctggaaataaggcgcaatttcaggaacctgctgtacttcccagaactgaagttttgcagaagtctgaagcatttttttcactttatcaatgtccttcataccaggcatttccacagaaattctagcggtaccaggtactctctgaacgtttggctggatggctccaagcttgtcaattctcgttctgattacctcaaaagctgttcctacagatgcatcgatctttcttttaacaatgctttttacctgctcgtcaggagtgttatacttcacctcagtaagggttgtatttccgaaaatttccggatctgccagcttaaggtttgcccctttagctttgtttactacatcgaactgctcaaaaaagttgtcgatgtaaggttttgtagaattcttctgtgcttcatccgtcttgtttaaagcctcgataagaacaggatttgtagaataatttgttaaatcattcacaagatctctttggttgatctccaaaagaacattgatccctcctttcaggtcaagaccaagtttcatttccttgtctttggctttagtgtaataaagttttgtgaatcctaagttcaaagtatccttagaaagtcttgcgatttctttctgatacttctccggattgtctcctgcaatagcagtcgcctgcttttcaattttgctggcgtaccatgttggtaatagctcgtttaagcaaatcaaccctagtacaatagcgacaattgtaataagtccttttccttgcattttgttataactacgttaaattaagtcggcaaatataatgattttcttgtattttatgaatttttaacaacagaaatggtttatttccagatatattggtattgtgatttctatttaagatttaacaattttttcgtgctatcatagcgaagttttcaaaatatattggtataaaattttcattccatttatcaacacactaactatcaaaatattatgaaaaaattacttttttgcatcagtattttttcttccttaattgttaattctcaaagcattaatttggaagaatttgtcacggggcttaccagtcctgtagagattacgaatgccaatgacagccgtctttttgttgtacagcaaaacgggatcattaaaattattcaacctaacggtacaatcaactccaccaattttctggatattagttcaaaaattatttttggaggcgaaagaggtcttcttagtctcgcatttcatccacaatactctgccaacgggtatttttttgtgtattataacaatacagccggaaatgttaccgtcgcaagatacagcgtaagttccacagatccgaatgtagctgatcccgcttctgaaaaaatccttctgagcattccgaaacctttcgacaatcataatggaggaagtattcatttcgctcccgacggaaaattatggatcattaccggagatggaggaagcggcggtgacccgaataataatgctcaaaacaaaaattcactgctcggaaaaatgctgagaatagatgtagatgctgccggcccatacaatattccgcccgacaatccttttgctggagccggagtggatggtgcagacgaaatatgggcttatggattaagaaatgcatggaaattttcttttgatcttacaacaggaaatgccatgattgcagatgttgggcagggagcaatagaagaaatcaacaaaatgcctgttattcaaggtggcttaaactacggctggcgctgttacgaagggaataatgcttacaacacagcaggatgtgccgcacagtctaccatgaccttccctgttgccgtatacgatcattccggagggaaatgttctatcacaggaggatatgtctacagaggcacccaatatccgtcattacagggtaaatatttctttgcagactactgctctacccagatcggtattctggatagtaataattctattacatggacgacaccttattccggaaataatttttctactttcggggaagattatcagaaagggctttatgtagcagctgtgaacaatggaaagatttttaaaataaccacaggtactttgggaactcaggaaaataatgccattggaaatataaaagtttatcctaatccggcttccaaagaagttttcattgatggagttaaagataaaaaagcaaccctagaaatcatcagtgcagacggaagaaaagtgatggaaacggataaagtctctaatggcaaaggaattaatatttcaggaattcctgccggagtgtattatattaatctgaaatccggggaactgaaatcatatagtcagaaattgattatcaaatagtaatagccggttttaagcgcaaacgaaacgctaaggttttttacattctatgaaaaaggatcgcaaaggcgcttcactaagcaaaaatattgctagacagagtggctttgcgaacaaaaaaataaatcggcattataaaatctttgcgaaccttccgtttaattatttttaaataaaggagttgtttaaactatcaaaaaatattgaatatttcttaaaccattaagaaggatttaagcagtaaagcatagttaagataaatcattctaatctttaaacttaaaacgaagcttatcttaatactctaaacaccttaatgccatcttaatggttcaaaaaagtttaaacaagttcaaaataagccataagtaaataaaaaaagcggttcagatctgaaccgcttttgcttatattgtcatagagaaaattctcgtttccggtttatttctcatcattctcaggtcaaaaaccatggctacattcctcgtgaatgctcttccggcttcagtaattttaacttcggttccgttgatttcaaccagaccgtcgttttccatctctttcagcatttccaaagcattttcaagctcagggaaagagttgtttatatcaaaagtggtctcaagctggcacatcagattcagaatatgtcttcttaccgtaagatcttcatcactcagtacgtgtccttttaccacaggaatttcaccttcttcaaccattttctgatattcctcaactgtttttacattctgggcaaacgcataccaggaatctgaaatagcagacataccaagtccaaccatcagctgggttttgctggaagtatagcccatgaaatttctgtgaagtttcttatgaattaaagactgataaagatcatcatgctcaagagagaagtgatccattccaacctcaatatatcctaaatcctgaagcagctttttcccgtcttcatacagacggcgtttttcttcaccacttggaaggtcattttcatcaaaacctctctgtccgactccttttacccatggaacgtgtgcataagaataaaatgcaagtctgtccggtttcagctccattgtttttctgatggtatattccatcgcttcccagttctgatgtggcaatccgaaaaccagatcatggctgattcctctgtacccgatttccttcgcccattcagtaacattttttacattttcaaaaggctggattctattgatcgctttctgaactttaggatcataatcctgaactccgaagctcactcttctgaaaccaaggtcatataaagtctgaagatgttctttcgtcgtattgtttggatgcccctcaaaagaaaactcaggatgctctgcaatatctactgtagaaaaaattccctccagtaatgttctcaaattttcaggagagaaaaatgtaggagtacctcctccaaggtgcaattctttcagttttggtctttcgctgaaaagatcaagatacaatttccactcttttaaaacactttcaaggtaaggaacttcaacactgtgctgtttggtaatacgtttatgacatgcacagaacgtacataacgcttcacagaaaggcaaatggatataaatagaaattccctcccctgcattgctttcatcaaaagacctgattacggtttccttccatctttccggcgaaaatgttgattcatcccagtaaggaacagtaggataagaagtgtaacgcggtccaggaatattatacttatctattaaagagttcattttgaaaattaaattttataaggcatgaaatttaacataattaaattcatcgtacaaaattaaccattagttatgaattttaacctatgaattatattaggttctattttataatgagtctaaatacgtatgatcaggcttttggctgatagtgatatattctattcctgatatttaaaattttaatttcatcaccgcaattttattatttcctgcaagaacaacattattgccatcaacccattgacagacaaagaatcctttttcgtcagaaattttcttccatgttcttccaaaatctgaagaataactgacgtgcttatctcctaccgcaagaatctcttttccttttgatcccggtttaattttcacacaagtcgtatatcctgcattctgccctgaggactgaatctgccaggtttcaccaccatcggtagtcgttgcgatattattgacattagcatcctgtttggtataatctcctccaacagcaattccaaacttatcttcataaaaatctatagaatacattccttgtgaagattctccctgaacaaatggagtattgaaaatttcaaacttttcatttttcagattcatttttataattcttgaagcttttcctccggttgcaatccaaagatattttttagaggatgaaatattggtattgctggcggcaaaagcagcctcaccctcatttaattttacattattcttaaacatgctccattttccgtctttgtacacagccagcttcagcagttgatctttatctgcatcactgaaggtataggcaagcttatcatttacgaaatgtaaggcatcataaaaagccgtttttgctgtatctttaaaaacaacctgtgaggtcagagtttttttatcaatggcaaaaaatcttcccggactttcaatattgatcgtatagaaagaagttttattctgccctaatgttctgaactgaagcttttcttcagacagtttcatctgcttctggtttttgtaatttttaagatctacaaacccgaatttggaatccgtaccgctataccatactttattatcgtataactcaagggctctgatacttattttatcattaagaatggtttcgaggctttccacctgctgggaaaacgctgcaagtcctgcggacagaaataaaatggtgaaaatctttttcatagtatagtattgtgacaaaaaaaaccgccgaagcggtttatataattattaatcctggttctgatatttttcaggattgttaagtttaccatgtgattttccataaaggaaatataccaaacctcccagtaccagccatacagctgaaagctctaatgcatgggcactcaggttaaaaatcagatataaattgataattactcccaatgctactacaattttataagcaggaaccttgaaaggtctgatcagatttggttctttttttctcattacccaaacggcgatacaaaccaaagtaaatgcaaacagggtcccgaagcttgtcatatctgccagtgttgaaatcggagtgaatgcagcaataaatgccactaccagtcctaacagaatgattcctttatatggagtctttgtttttggatgaagctgaccgaagaattgaggaatcaacccgtcttttgccataccgataaagattctggattgtcccatcatcattaccattacaacggaaattaatcctaccgtagcagcaatcgttacgatattacttgcccagtgttttcctgcaatttcaaaagcataggctacaggagctttgatagcatcaggatatttaccttcagggttgaagtctgtataatgcatcattcctgttaatacaagagatacacagatatataaagcggtacagattaacagtgacgcaatgatagcgaaagggacatcttttttaggattaatagcttcacccgcctgtgtagaaacagcatcaaaaccaatataggcaaagaaaatagctgcagctccggaaataatccctttaataccatatgcggagaccagatccccttcagagtttttgatttttacaggatccgggatgaaaggtttccagtttttaaccccatctacagcattgtaaagatttgtattagaaaaaataatatatactcctgcgataattacaaaaataacagctgatgtcttcattaaaacaatcaggttattagctcctgcagcttctttagttccttttaccaataatgcagtaattaaaagaaccagaataaatgcaggcaggttcatagaaaatccatctccggtataacttgcaggatctgaagtcagataggcagggagatgaatattaaatattttcaaaaatttgttaaaatatccggaccagcttacggaaactgccatactcgccatagcatattcgaggatgagacaccaacccatggcccaggcaaaaatttctcctactgttccgtatgcatacgcataagcagacccttctacaggaatgatggatgcaaactctgcataacataatgcagcaaaaacgcaggcgatccctgctatgataaaggaaatggcaagtgctggtcctgcatgataataggctcctgttccggtaagaacaaagattccaccaccaatgatagcacctactccaattgctgttaaactccactttccaaggactttcttcagctcacttttcttcatatctgcctcataggcacttagtggctttttaacccaaattttcgacatgtttttttatttatttaaggatttacgaaaatataaaaaatttagaaactctcacgttaatcgttaaaatttcatcatttattttacattaaaaactttaaaaacctgaccaacaccttattcatactattttatcaagtgttaaatttttctttatttttgataacatgaatttatatgatcttttcataaagccttatgagagctatgataccttacagattatgctagaagcttcaggagctgtattaggaaccttaagcgtctatttttcgattaaaaaaaacatatgggtataccccaccggtattgtttctacaatgatctatgtgtatattctcttcaactttggtttattgggagactgcctgatcaatgtgtattataccatcatgagtatctacgggtggattttatgggctaaaaattccgaagatcatattcatgtggacgttacctgggctgccagaaaggaatggatctatgccagcattctttttatattgagcctcgcgcttgttactcttatttattattataaaccttatattgataatcaattttctatggaaggaaccagtcttggattatatcatctggattgggcaaactggatggatgttttcaccacttcaatatttttagtaggaatgtggtttatggccaaacagcgcattgagagctggattttctggattatcggagaccttatttgcatccctatgatgatttttaagggacttggaatcacttcggttcaatatttggtatttactataatggcgatctcaggatacgtcaattggaaaaaaagttttaaagaaaaaagtacaataaagtcatgaaaaatttatttaaaatagcagtcagtatttttgctattgccagtttaacatcttgtttagcatataccgacggatacggtagcaataatggaggttattatggagatccctattataacaacggatattactatgctcctgcaggatactacggaagcggtggatattggggcaacgacggctattattacagaaacaacgttaattattactatgataatggcatcccttattattatgacaattataataattccagaagaaaagtctatgtagaaagaagatctgcttcttcaagacctcagaacggattccagaatacccgtacaacaaataataacggttcatacaataataacagcggaggattcaataataacagaaactccaacagcaacagcggattcagaaaccagaacagcggttatcagaacaatcagggaaaccagaacaatagtgggttcagaaaccaaaacaatgggaatcagaacaaccagaacaacaacggtttcagaaattccaatagtaatggcggattcagaaattctgaaagcagcagatctgaatcttccggtggtggattcagaaacagctcaggcagccaaagcaccagctccagcagacagcagagcggcggaggcggttttagataaaacgattataaataagaaaacgaacagctaacactgttcgtttttcattttaaatatgttaattttgcttcttcatttaacaaaaaaatatggaattttataaatatcagggaacagggaatgattttgtaatggtagacaaccgtgatctgcaatttactaaggataaaggtattattgaaaaactatgtgacagacgcttcggaataggtgctgacggtcttattctcttggaaaacgatcccaattatgattttaaaatggtatactataattctgacggaggtgagagtaccatgtgcgggaacggaggaagatgtcttgtagcttttgcttttttcctggatatctttgaagataaatgcagattcattgcgacggacggcgaacatgaagctgaaattcataatggaattatcaaattaaagatgattaatgtagacgcggtatcccatgacggaaatgacttcgttctgaataccggttctccccattatgtaaaatatgttgaaaatctgaaggattatcctgtgtatgatgaaggatatggaatcagaaattctgaaacttataaagaaaaaggaatcaatgtgaactttgtagaaaaaatttcagataatgaaatttttgtaagaacctatgaacgaggcgttgaggacgaaacttacagttgcgggacaggagttacagcttctgctttaacttttctgcaaaaacataatctaacctctgtaaaagttaaaaccttaggtggaaatcttaaggtatatgctgaaaaaagcggtgactcattccagaatatatggcttgaaggtcctgcaaagcaggtttttagaggtaaaacagatcttctttaaaaacagaaacttttaatcaacattaacaggaatgaaaaaagctattctcattatcattctgctggtttttatagtggcaggattttttggtttgagattttataataaatatttaggaaataacgtagaaaaagaaggttatgtgctgattcctcacagggcaggttttaagcagatcctcgactctattactccttatattaaagacagggaatcttttgaagcagtggctaaagaaaaaggtcttgatacgaattttaaagcaggacgttatcacatccaaagcggaacaggaaacaaaaaccttgtcaatatgattaaagcaggaaaccagacagcaaattcttacaggattggtgattttggggatatgtatcagatgattggtaaggttaccaaaaaaacagaaatagattcattacattttgtaactgacctggatgctgttgcacaggagaaaggatacaaaaatgctgaggatttaaaaaaatattttttcattgatacgtataattttttctggacggtaagtccgagagaattttttgccaagtttgaagatcagtataatgatttctggacggctgaaagaaaaaataaagaacagcagtccggtctcacaagagatcagatatatgctctggcctctattgtctataaggaatcgggaggaaaaaaagatgagatgaaaacgattgccggattgtatttaaaccgttacagaaaaggaatgaaacttcagtctgatcctacggtaatttatgcgatcaataaacagactaattttaaagaacctataaaaagggtattatataagcatttgtctacaccatcaccttataacacttatgccaatgcagggattcctccggggccaatctgtgtagtggataaaaactcaatagatgctgttttaaatgctgaaaacaacaattatatatttatgtgtgccgatccttcaagacccggataccataagtttacggcaagcgctgaagagcatgctgtaaatgcaaaggcttatcaggactggctcaactcaaaaaatataaaataggcttaaaaagcaccaagaaacttatacagttagaaaacaataaacgcgaccataatattttgatgatcaaacagatgtgaaattcaaaatattaagggttattctttcacgatcttatacaaaaaaataacctatgaagaataagacagaaattgtcactattttcaccagaaaaactttaggacttacgttagtactttcagcggcagcattagcttttgcacaggagaaagctggagtttcagggactattgtcaacaaaaaaaaccaaccggtaccttatgcctctgtaactttcagtaataagaccaacaaaacattaagcgatgctgtactgacagatgaaaaaggacagtataagattcagcttatgcccggcgattatgaaattacagtagaagctattgattacaagaaaagtgtagtcagcaaaaatattgcagcagcaggtaatatcggggctttgtctattgaggctgaacctacctctactgttgacggtaaaacaaaagaaatacaaggcgttgtgattactgcttcagcagcaaaaccttataaagtagagcttgacaaaaaaacatatgatccttcacaggatattgtgagtaaaggaggaaatcttcaggatgttttaaccaatgttccttcagtttccgtagatacggacggaacagtatctatgagaggaagcaccaatgtaaagtttctgatcaatggaaagccttctgccctgcttgggatagatgacggagccaatgcgttacagagtattcctgccgaccagatcgaaagaattgaggttattaccaatccttcttctaaattcgaagcaagcggaacatccggtattttgaatatcatccttaaaaagaacaaaaaggttggatttaatggtagtgtggtaggatctctgggctattttccaagaacctctcttaacacgaacctgagctggagaaaaaataactggacctggtttctaaacggcggtggcggctacacagaaaataaaaccaagaacaattcggaaacaacctatcataaccttactttccctgaggtagttgctaatcagcagcctaatgatgttctggcacatcagctgcaaaactccaccaataaaacatataacaaaaattataatgtaagcgctggggttgtatatgatttatcggataagacctcaatcaattttacgggattggtgagaacatttgaaggagatggaaatgaacttcttgatacttatgacagtttttacaggtttttcagagattcacccgatccaagtacaacagcaggaaaatggaatttattaaatccgtctggaataagagattccaagagtgtattcaataatcttgctttccagggagatctgggattggatcacaaatttgacgataacggacaaaatttatccatatcattaagtctgcaacggaacagaagtaacaataatgcggatattcttgaaacttatgatcttcgtcctgatatacaggatattaccaaaagacattctgtaagtaaaacgattattggtaaagctgattatgagctgccaataggagaacaatccaagcttgaagctggatatagattggatgttaatgataatacttatgataattttgtaagcagtacttccaacaacccttttattccgagctacaataataatacagattataaggaaatcttcaacgctttctatcttcagtttaagagcaaaatcggagaaaaatttgcttaccagcttggcttaagagatgagctgtctaatgtcagcatcaattatattaataaaaatcctaatgataagccattagacaaaagcaaaaactataataatttatttccgagtgtattcttaagctatgatatatccaaaaacaatcagattttgcttaattattcccgcagaatagacagaccaagatcattcttcatggtccctttcccgaattatagcaacagtcagaatatttttgaaggaaacatagacctgaatccatcgtatgtagattcatttgaagtaggatataatatcaccagaaaaaagtttacggttaaccctaccctatactacagacatacaactgatgataccaaaatgctggtctacagacctgatgaaagccttggagtattctacacaaagcctatcaacttaggaactgatgaccgttatggtttggatctgaactttacttatgatccttttgcatggttgaagataatgggaagtctggacatgttcggatataaaaccagcggaatcgcttattatgatgccattgataaaaatgagctgcaccaaacccgtgacatgaactttacaggaaatggcttttctaccagagcccgtcttaatacgacatttaaacttgacaaaacgctaagtgtacaattacagggattctatagaggagcacagaaaactgccagccaaaatacacaagatatgtatgcgctgaatcttggtgcctctaaaacgatctggaaaggagacggaacaatttccttcaatattcaggatatattcaatacaagaagcagagaagtattcagtttcaatgatgactatacacgaagaaactatatgcagtggcagccaagacagtttgctatttccttaacttatagatttaagcagggagaaaaaattgaccagcctaaaaagaaaaaggatatcaattccaacgcaacgggcgacgaccaacaaggcggtccaatgtaacagaatataatacaactaaaaaatcccgaaaatattttcgggattttattttttattaataactgttattttacaggctctgctttcgagtatttctctttttcagcttcatagattcttcttctcagatcgctggtggaaaacctatggtctcttttattgtaaaagatttcaattcctttttcttcacagtattttttacctgtaaaatctttgtccatataatcatctccgatgattcttacatcaatcacaaatgattttaaaatatccaacagatcttcttccgtgtaataaggaatgatctcatctacagcatttactgctttcagctgaatatacctttcaactatagtctggcttggcttatttttgtttggacgatcgtgggatggatcgatctgaagtcctacgattaaatagtcacatactgttttagcttcttcaagcattttgatgtgtcctgcatgcaataagtcaaatgacgaaaatgtaatacctattctctgtgtcttcatattaatttaaaattaaaactccgctgaaataagtggtccttttaaggagaaacacaagtgattcagggaaggtgttttgtaatttgttttatatttaattattctttccaaacgtaaatatagcaatacttaagtttatgaatttctgctgttcagatatttctgccactcccatactgtttttaaagcttcctcaagggatgtttcagatttccagttgagttctctttctgctttttcaggattcgcatatgctattgtaatatctccttctcttctgtcacagatctgatagggcacttccacattattagccttttcaaatgcttttaccacttccagcacagatgatccttttcctgttcccagattataaatatcaattactgtttctgctgaagagtcttctatcagttttttcaatgctgcaacatgcgctttcgccaggtcaacaacataaatataatcacggataggagttccgtcttctgtgggataatcatctccccagatgttcagtttctctcttactcctgacgcagtctgcatcacgtaaggcaccaggttattgggaattccgatcggcaattcgccaagtttggcagatgggtgtgcgccaataggattgaaatatcttaacaacgatattttactgccataggccttcgcaaaatcaatcaggatctcttctcccatttgttttgtttttccatatacactttccggtgtttttaatggagtattttcatctatcggcattacatctgcctgtccgtataccgtacatgatgaactgaaaataaaattagagatttttctttccttaaattcctgaagaatattaattaaagagaacagattattttcataataatctataggttttacctgactctctcctactgctttagaagctgcaaaattgatacatccatcaatctgatgcgcatcaaaaacctgagtaagcagttcttttcttctcaggtcaaaaggataaaaagcaggcttcacccctgtaatttcctcaatattatttaaaataaacctctccgtattggataaatcatcaacaataaccacttcaaagccgttattgataagttctactacagtatgagaaccaatatatccaagtcccccggtaacaagtattgccattcttattttttaatcttcgctttttcctatatcatctaattctagaaactgtactcttttatttttgaaaacattcgttattaaaagaaaaactgacaaggtagaaaaaatggaaaaaaatttcaatgtatcaccttcctcaaacgatttttcaataaaaattttaatacagcccaaaacgagaaataataaaatcaaaatataattaatatttaaataaagaatagttcttttgcttttcaataaaagtaaaattaagcttaaaaatgcacttataaatattgatcctgcaaagagaaaaataaaactctctactgaaaatatctgctctatactgaattcaataaatgaatcataagtaccatagccaaataaaaaaagtaaaaacaactcgaatagaaatactactattccaactattctatatttgaatattctgtttttcattaattatcccataaactcaagcactgcatccgtaatatactttagctgctcttcgtctaattctgtatgcattggtaaagaaattacctgatccaaaagtttatcggtatttacaaaatctgcaggattactttcctggaagtatgctttttgttttctcaatgctacaggataataaatcattgcaggaatttctttttccgccaaaaacttctgaagttcattacgttttccgttcaggattcttaaagtatactgatggaatacatgggtagaattttcagctctttttggagtcaggatatccgggtgaccagaaaatgcttcatcataaaaatcggctgctcttcttcttgcttcgttataagaatcaaggtgaggaagtttctttcttaaaactgcagcctgaatgctatccagacgtgagtttactccaacctcatcatggtaatatctttcatacatcccatggtttacaattcctcttaaacggtgagccagttcatcattattggtaaaaatagccccgccgtctccgtagcagccaaggttttttgatggaaaaaaagaagttgttcctacagtagacattgttccggcctgttttaccgttccgtccgagaatgtatattctgaaccaattgcctgagcgttgtcttcaataacatataagttgtgctcttcagcaatttttaaaatttcttccatattggcacactgtccgaaaatatgtaccgggataatcgcttttgttcttggtgtaattgcttttttaatctgctctgtggagattgtaaatgtatcataatctacatctaccaatacagattttaacttaagcaggtgaataacttctaccgttgcagcaaaagtaaaatcagctgtaataatttcatctccttctttcagatccaaagccatcagggcaatctgtaatgcatctgtaccattggcacacggaatcacatgttttacgtctaaataagactccaattcattctggaaagactttacttcaggaccgttgataaatgccgcagaatccattacatttaaaactgcattgtctacatcattctttattttgtaatactgactttgcaagtcaaccatctgaatttttttcatataataaatatttctgtaaaaataaggattttaatatctgatcaaaaattttattgattttgtttttatctttatacaaataaattttatgaaaaaacttttactcttttgtttcctaacaagttaccttactgtttccgcacaaaccgagctcgtcttcgtttactttacggataagccgaataaggctgcattttatgcaaatccactctcggaactcagtcaaaaatccctcaacagacgtaccacgctgggaataccgctgaatgatcaggacgctcctattgaacagtcttacattcagaatcttcagaatttaggatttaccgttactgattattcaaaatggcttaatggtgcagccgtaaatgccactcctgcccaaaaaatcttattgcagtcacagtctttcgtttcctctgttgaaagctttgccagaaataattccggtacattaaagacagcaccttcaaaatggaaagacgatgcaagcatcaataaaacactgaccaactttaattacggttcaggcgctgcacaaattgaccaggttaatatacgccctcttcatctggccggctttaccggaaccggaatttctatagcagtcattgatgccggatttcccacagtgaatacaggtgcagcatttgcgaggttatggaccaataaccacatcaaagcatcttatgattttgttaccaaaaccgcagatatctataatgcttctctcagcactcatggttctgttgttttaggaactatcggcggatatctgcaaaacacttttgtaggggcagctcctgatgcagatttttacctttatcgcagtgaaaatgctgtggtagagattcctgaagaagagctatattggattgaagcggctgaggaagcagacagaaaaggtgtagacattattacttcatcactgggatataatattttcgatgacagccgttacaattattcatatgcaaacatggacggaaatacctctttcattgcccgtggggcaggtattgccgcagaaaaaggaatttttgttcttgccgcggccggtaattcgggacagcagccatggcattatcttctgacaccatctgataatgctaaagtcttctctatcggttctgtggattctgccggaaatacgtctggattttcttctttcggaccaaacgctttaggcgtggtaaaaccagacggaagcactcagggaaccggtacaacaacagtttatgataatgctacgctggtggtgaacggaacctccattgccactcctattgccgcaggaggtgtggcatgtcttatccaggcttttccaaccatgaacagggaacagatgagaacaaaattgagacaaaccgcttccctatatcccgcccattcggatcagatcggatatgggatccttaatttcgggagcttatacaatctcgttctcaatacttctgaaatcgtaaaaaaggaaaagttttccatatttccgaatccagcgaaaagcatcctgaatattgcgtcagaacaggaaattctttcattagaaatttatgataacctgggaagactcatcaggaaaagcaaccatcagaaatctataaaagtagaggattttgcaaaaggaacctattatctgaagattcagttgaaggataaggtcttctatgaaaaattcttgaaggaataattatttgtttcccgcagattgtgcagatggattacaacataaacatctgtacaatctgtgggagatacattactatttctggtcgtattacaacataaaaataagtttgagctaaagcttattgaatggtttataataaaaaaacgggctttaacccgtttctattgataatgattatcatctttatgatcattcttattttaaaaaatagcttatgcagagtttctactggcattaatatttccgaacagcgagcgtgttaccagcttttcataagcttccttgttgccttctcctttctgaatcttcattaaagcatactgctgaatgcttaacaacggaagcacaatcttttcacggatcttcacagattttcttgatagaggatcctcttcctgaagcattttgaatccggtcagttcgagcataatatctctggaaagctcatattcatcgaaaagaacattccagaatgctccgaatttaggattatttttaatgtagtaggttaacgggaaataagacttgttcatactcatcatcgagttcagaactaaagttttaaagaaatcggaacctttgtacagttctattacttcttcaaaccttccctgttctttcatcttctgcatggcatatccaaaaccaaagaaaccaggaacattctgcttcagctgtgaccatgaacctacaaacgggatcgctctcagatcctcgaatttcagctcgctgccatttcctctttttgaaggacggcttccgatattcgtttttccataatattcaagtgtactcatttcctgtaggtaaggaacaaacattggatgagctttcaggtctgaatattttttatagctgatatccgccaattcgatgattaaagctctttccttttctgtgagttctttttttgcatttttaaatacatcattttcaattccggcagtgagaagctgttcaaaattgtattttgcctgctctttgtttccgaaaatactcgttatggtttgaccctgaatggttaattcaatcttattattggcaatcgtttttccctgagaagcatagaagtcgtgtgtttttccacctcctcttgccggtggtccgcctctgccatcaaagaaaacaactttgatattattctgttccgaaagttttgtcagtacttctttagctttataaatttcccagttggcttttaaataaccaccatctttggttccatccgagaatcccagcataatcgtctgctggtttcctcttttttccagatgttttttatagacaggattctgatacagctcactcattacatgttcagcattggcaagcccttccattgtttcgaagagcggaacgatatccatattgatatcttcgtctttatacccacatactttgaagaatgcatagacattcattacgtcttttactgcatcagaattggaaattatataacggttcattcctctcaggccgttcagatgctgaatatctgtaacctgtgagacggttaataaagtatcttttacaatatcttcaaaatcttcaggatttatcttttcagaaatctgaataagcttattgaatttctgttcataatctgcttcttcattcccgtatacttttgcatacacctcatcaatgactttctgatgaatcctgctgtcctgacggatatccaaagttgcaaagtgggttccgaaaatcattacacggtctctgaaattcaccaaaagatctaaaaacaaagaattatgctcattgatcagtattttttccgcttctgcagccctttttaaaatatcttctgccttaatgtcttttccatcaaaaatagcagcataaagctcttcacttaattgggtcagaacttcagaaactcccctgaaacttaatcttcttcggataaatttcagatggctgtaataagatttcagaatggctgaacgcagttcttccgctactcttttcgttacatccgctgttacaaaaggatttccgtctctgtctccgccaggccagaaaccaagctggataatatcttcatgaaggtggaaatggccgtttccgaaagtcttcttgattttggtaaacagttccccaatggtatcataatatacatatctcaggtaagaaataatactcagcgcttcatctatcggagtcggtttttctttgttgacaaaaggagtctttcccagctgctgcaaaagcatatcaatctgagtcacggaatcactggtgatggcccctctcagatcctgaataatcctttgtactgagcttggataaaactgggtggggtgcgccgtaaatacaacctttacactgaaatcttttaatttctcccttactttttcaatcttatggtcctgcaaagagcgttcaaaaagattggtgaccgtaccattatcgctttcagaatgaagatttggaaatgctgcatcttcaatactgtcgaacaaaactacctgtctttctatatattgtatgatcttgaaaagcagttcaagtttctgctcttccgtctggagatcggtatgattcttaaaaaattcttcgacgatattttcaggtgtttttcctgcttcataaccggttctgctttcctcataaagaaacggaagcagcattccgatattcgtcattttatcataaggcaggctcataaataatgaattatagatctggaacttattttccacaatctgcctgaatttttctgcgcgttggtcgtgtatcatagtaacaaatgtaagcgattttcaaattagttggattgacaaatgacaaaaattaatggtgaaaatcaaaaaattatttaaattttttaaataatttttcaggtcaaaagcatgatttaaccatgaaatattttgtgcagcttttgacaatacagagattctttttaaaaactcaggtttaatataattttgattaattttactctcaataccatccataatctatgaaaaaaacttttattttcttacttatgacgtttctgttgatatcctgtgaaaaggattgttacaatgcgccattacccatcatctttgaatttgtgaattctgacaatgaaaacctcattgccaacgggacactgaccagctattcggttcaggatgaaaataatatgaatgtgcagctaagcaaaacatcggacaacaaggttattctggaaaatgtaggagcctataacggaacaaaaaactataagttttattctaatatcaaaaaccttgatttttcaatccagtcatctgaatttaaaggaggctgtgatggctatcaaatcaataagctgacttttaccggaataaattttgatgtaactgacgaaaaaggatattataaaattgtattggaataattctctttctaaatttgtacctggaaacacattctttatgaaagccatcatcacctttttcctgatcttctccaatcttctttacagccagatcaaggttcctgatgattataaaaaaattcccgacattcttgatactacagaatatctctacccgttcattgtgccggataaagagtatgcttactggcgtgtcctcagcaacgatatggactatgaaaaagctgtgatctatgaaagccaggctcccgattttatgacgattaatgaacctgttcccgaaaaaggtttttttcagaaatgtattggtaacaattgtttttcataccttcttgcatgtaagaatgaaagatcggtttatttttccagtgaacagcagttaagagactttatcggaactgtggataatcttcctgaagctattttactggcaaaaacctatggctattcggttgataccaacaaccgatttaccggggcttataaaattgaagaccgccatatttccatgtacctgatgcagtctaaaggctgtccggttgtaaaggagtcttttttagttaaaatcaacagaaaaaccggaaaactggaggcgaagagcaatggggtttatgcaaaagatgaaaactgttctattttgtaaatgatgattgtgaaaatacttaaaattgaaaatcttattttaaaccattaaggttttaagctggtaagagtacttaagggtaacagcgaaagctattttttagcgatgtgctttatttttccatcagagatggatcttaactatccttcttatcttcattaaccttaatggtttaatttttatatattgacagctccctgtccggaagctatcagataagcttccttcaacgtttcagaataggttggatgggcataggaaatacggaacatgtcttctgcggtcacttcatattcctgggcaataacaccttgtgcgatcagatcggcagctctggcaccaatgatatgaacacccaaaacttctccatacttcggatctaccaaaactttagcaaagccttccatgtccattgaggcccgggcccttgcgctggcagaaaacgggaattttccgacattgtaagctatattgttttttttgaggtattcttctgtataccctaccgaagctacttcaggccacgtatagaccactgaaggaatacggttataatgaatatgacgcttttgcccgttgatcgtttctgccaccaaaacaccttcttcctcagctttgtgagccagcatcgcaccgccgataacatcacctattgcatagatattgaagacggaagtctgattgttttcattcactttaatgaaccctctctcatcaagctgtacatctgtattttcaagaccaagacctttgacatacggacttcttcccacagctaccaatacataatctgcttccagcgttgcttctgttccgttttgatctttaaaaaacaccttagcggcagaacctgtattttcagttttataaaccgcctgattgagacggatatcaactccttcttttttcaggattttctgcaggctctttccaagctcatgatccattgctgcaatcagatgatctgcatattccaggatagtaacttttgttccgatacggttaaaaatagaagccatttccactcctattacccctcctccgataatcaccatagattccggcttttccatcagggataaagcttccgtagaggtaatgattctttgtttgtcaatttcaactccgggaatgcttgatggttttgaacccgtcgcaatgatataatattgtgccgtaatttctttaatttcagaatcgtttgcaacttttatcgtggaattattaataaaacttgccgttccttttaaccgggtaattttattcttattcattaaaaagtcgagacctccggtattttttgaaacgacatctgctttcctcctgtacatctgagagaaatcaagctctattgtatccagcctgataccatgttcattgaatttatggtgtgcttctgcataatgatgggtgctgtccagtaaagctttagtaggaatacatcctacattggtacatgttcctcccaatgtatcatacttttctacaattactgttttataccccaactgggcacttcttatagcagctacatatcctccaggtcctgagccaattacggcaatgtcatatcgatccatttgatttattactttttttgattaaatttacttgcaaaacaaaagcaaaattaaaacaaacactttcattttgcaagtattatttttaaaattaacaaaatgagtaaaaaaagatcagactgccccattagctgttcattggaaatgtggggcgataagtggtcactgcttatcataagagatcttatgctgaaaaaggaatgtacctatggtgactttctgaaagcagacgaaaaaatagcgacaaatatcctggcatccaagcttcagaatctgctggataatggcattattaataagaaagaccatccggacagtaagttgaaggttctgtattttctgactcagaaaggaataaatcttattcctgtaattgtagaaattaatctttggggagatcagtatttgactattcctgatgaccgtaaaaagcttattgaggatattaaaaaggataaggaaggttttataaagagagcaaaagcttatctttcatcagaagtttaatgtaatcttcaaaagttaaaaaaaataatagctttcataaaaatgagtgatagcaattttaaaatttcattaactctcttttcctttttcattccgtacatttgacttaaaataaatttagaacaatgcttaatttcgagtttaaaaacccaacaaaaatacttttcggaaaaggcgaaatcgcgaaaatttccaaagaaattcctaaagacgcaagaatcttaatgatttacggtggtggaagcatcaaaaacaatggtgtatacgaccaggtaaaagaagctttgacagaccatgaagtgtacgaattcggcggagtgccggccaatccggagtatgaagtactgatgaatgcgttaagctttattaaagaaaaaaacatcacttaccttcttgcagtaggtggaggatctgtgattgacggaacgaaattcctttctgcagctgccaattatgatggcgaaccatgggatatcctgagaaaatctgtacggacttttgaaggcgaaggaatgccattcggaagtatcttaactcttccggcaaccggttccgagatgaattccggatatgtgatctcaagaagagaaaccaatgagaaactgtcttcaggaggaccgggacttttcccgcagttttctgtactggacccggaagtgatcagatctatcccaaaaaatcagattgtgaacggaattacagatgcctacactcacgttcttgaacaatatatgacggctccttcttcggctgaccttcaggaaagaattgcagaaagtattctgatcagcctgcaggaaacggctcctaaagtattggctgatgatttcaactacgatgctgccggaaactttatgtggtgctgtacaatggccttgaacggactgatccagaaaggagtgattaccgactgggcggtgcatgcaatgggtcatgaactgacagcttattttggtattgaccacgccagaacactggctattattgctccgtcgcattaccgttataactttgaagataaaaaaggaaaactggctcagtatgcagaaagggtttggggaatcaaagatggaagtgtagaagaaaaagcagaattgggtatcaaaaaactggaagaattcttccacagccttcatatcaaaaccagactttctgaatacacggatgactttaaaggaacagccgaaaaggttgaaaaagcttttacagacagaaactggctgggtcttggtgagtataaaaaactgactccacaggacgcttataagattgtggagatgagctattaaaaggattcggggtgcgggattcggaattggaggataatatttattttaattcatattcactttcaaagcgaaaatagataacccgaaacccacatcccgtatttcaacctctataaaattatttaatttacaaacatttgtttaaaaaatcattatttcattacagatatttcaaatttatttatattttagcatattcttaaatttgtgaaaatgaaaaaacaactacttttatttaccttttctgcccttgcacttacttcttgtaaagatgacaacctggaagcttacgatatggagattatgaagggagactggaaggaagtaaaaaaggaaataatttcaggaaaagataataaaacagtacttttttcctatccgaataccggatgcgcagccaaaaacacacttttcctgagaacagattattacgtaagctatacggcatatacgggaacaggagcagattgtcagatggatcagaaaagtgaaggaaggtacacttatgatgcagacacaaaaattctgggtattaagcttggtgatgaaggaacagctgactacagagtggatgttctgacaagcaaagaactaaggcttgcccagcaattcggaaactttgatatggatggagacaaaattcctgaagttgcttacgttacttacaaaagataaatcatagactcccgctaatcgggagttttttattatttttatatcttaatttaaaactgaatataatgaagaagattctatcagcattcttattgctgtattttgctattgctttttctcaggagaaaaaaccgatgtactggcaggacatccaggagtttaaaaagcaggaccagcaaaacccgcctccaaaagatgccattcttttcatcggaagctcctcttttaccaaatggactgatgtagcagattattttcccggcaaaacaattattaatagaggatttggaggttccagacttactgacctcaattattttgctgatgatcttttagcaccttatcagcctaagcagattgttatttattgtggggaaaatgattttgcagacaatcatcagctgaaagcaaaagtggttgtagaccgatttaaagctttctacaaaaaaatacgtgaaagatttcctgatattgaagtagattatatctcaatcaagtattcgccgagcagagaagtgatctggcctcaaatgaaagttgccaacaaaaagatcgctgctttcatgaaaaagcaacctaatgctgaattcattgacattacaaaagccatggaagatgctaacggaaatgtgagaaaggatatttttgtggaagatatgcttcactttaagccggaaggatacaaaatctgggcaaaggtgatcaagccctacctgaaataaacgacgacccatgataaaaaaaacaataaccattttatgctctgttttactgtattctgtttcattttctcaggagaaaccgaatgaaaaaacagttcttcaggaactctcggaaaatgcctgtaaatgcgctgatactatttctctgtctaacagaaagaaagaagagatcatcaaagatattcatcagtgtattgatcaatacgcaggagcacttcagatctctacacttttgaaaggggcagaaaaacaatctgaaaatacaccagaagtaaacggtaaaaagcagattaatctgactttcaacaccaataaggattccaagcaatacagagacagctataatgagcttgaacgttatctgatgcagaactgtgaaagtgtaaagagggctaccacaaattcagaaaccagccacgataagttctcaaaaaatgcaaaggctcttgatttctaccagaaagccattgatgcatccaaaaaggaaagctggaatgaggcgattcagaattatgaacaagctgtaaagagtgatccgaaatttatttacgcatgggataatctgggaatttgctataggagagttggagaatacgataaggcccttaatgcttatcaacagtcattagctgtagattcaaagggcaaaatgcctttacagaatatacccatcgcctatatttataaaaaagaatatcagaaagctattgatgcttatcataatttagataaggtataccccaatgatccggaggtttattatggaataggacaaatctacttcactcaactgaaagataatgaaaaagggcttgattatatctgcaaagcatacagaatttacaatgaccagaagtctccttaccgttctgatgcggaatccgtaataagccgtatttataaggggatgaaagaggaaggaaagatagataagttcaaagaaattttaaaaagcaataacattcaaattgactaaaataaaaactcccgggtgaatccgggagtttttattttatttctttctttttgatttagattttgctttctgctgagctctgttcgctccaaactttttaggcgcctttcttttggaaggtccaccccagttctctttagtgtttttagctttcttctcatggaatgctcctcccccttcattcagttttacctgtgcaggattcttcatcaccacttcatctttttcagaagctattttgttaggattgatcttaacgccttccgggaattcattaaatttcaattctttatccattaacagctcaatatcaagaattaaaggttcttcttttttagtcacaaaaaccaaagcctttccttctttatccgctctaccggttctaccaatcctgtggatatactgctcaggaatatcaggtgtttcaaaattgataacatgggtaatattggaaatatcaagacctcttgccattacgtctgtagtaattagacctctgatctcttcattttcgaaccttttcatcgctttcaacctgtagttctgcgatttgttagaatggatcacgtcaaactgttcagggaaaagctcatcaattttagtaaagagcaaatcggcatgctttttattgttgttaaaaatcaataccttggacatatctgcatcgttcttcaacaaatattcaagcaaattgattttggtattaaagttttcaaccttgtacccgatctgttcaattttttcaagcggcgttcctgatttagccaatgaaatctctaccggattggcaaaatagacatccagcatttcatctaccgcttctgtcattgttgcagagaaaagaatattctgtctcttctctttcatcatttcaaaaatgtgggtcagctgtggtctgaaacctaagttaagcatttcatcaaactcgtcaatgatcagcttctgaacttctttcagagaaatagcattatctatggaaaggtccatcactctacctggtgttcctaccagaatatcacaaccgtcattgaacagtaatttttgggtattgatattctttccaccgtaaactccaattactcttgccgtaatattttctgtaagcttctcaagaatttcagttacctgcaccaccaattctcttgtaggaaccagcaccaaaacagttggatttcctgttttgctgtatttccatgttttcagaacgggtaaaagataggctaatgtttttccggttccggtctgtgcaattcccattacatctcttcctgagagaataggttttaagctcttctcctgaatcggggtaggttcaaataattcgagatccgctaaaacatcaagaattttaaccggcaggtcaaaatctgcaaaagtgagtttttccattttgcaaagataggtatttaattttgtagtatggaagcacgaagcctgaagctggaagattatcaaacgttctttaattttttgaatgtacaatgaaaccgattaatatattaacacaggtcatttccttccctcttccagcctccagctattttaatcaattcaccttaacactttcactgataattttaatatcatcatctatccacttgcttgaggtaacaatgacataaccattctttttcggatcttttctgataggaaaccgatcttcttcccactgattacaatgggtagaaatagacggtaataatggcttccagcccgctttacttaaagtatatacgtagaacggatgccagcagctggtacaccaatacggataaaagccaatttcatcttttccgtcaccgttaaggtcaccaagattatagagacttccctgattcgctggtgtaattgttatcgattgtatatttttatcactgaaataaatggttgtttcacattttccttcacattcctcaccacagtcggtgacttttgtgtaagcgtattctttggttccgtttccgtcaaaatctccaagaagtttttcttcatttccttgttgagccatacaaagtgagctgaataaggtgatggatgttataataagtgttttcattgtttttagtttaaatacgggtttgggattcgagttacgggttgcgaggtgcgcgggattagggtttatacattcttcggattcaaattcaacttcctttttattttctggttactctcagcagtaaaattataaccaaaaggattgagaagataaagcccaaaaccgctaccagagagagctctcctattcttggtccggattctgatgaaaaaacgattgccgtggcaatgatattggcacccaggaccatcgccagaatcagatttaccacactggatttgatcagttggttggttttttcaatattttttatctcgctggaaacagtaaacttgttttcgtcaagtttttgcagtacagaacggagttctttcgggatttcatctacattatcggtgaaattcatcatccggtccattcctgtttttaaaaggttcttcggactgatttttttggtgaatatctttttggtgtaaggatgaaggcttttaacaatatcgagatcaggattaatacttctgccaactccttctatcaagctgattcctttgaataaaagatagaaataatccggcatataaagcctgttgtctttcagaatatccttcattttgttgatgattacctgaacattgatatcctgtaatgacgaactgtgaacaaaattcagaatatcttccacatcattttcaaaccgtctttcatcagggatttcatagcttatggccattttcttgagtgaacggactattttatgggaatttttggccacaaaacttacgataagattttcaagaatttctttgtcattaggctgaattttccctactgcaccaaaatcaatgaaaacaattttaccatctttttttaccagaatattcccggcgtgaggatcagcatgaaagaatccatagtctaagatctgagaaacaaagagccttaatcctgtttcagaaatttttacaggatcaatatcattggccagaagaactgatttatcggtaacttttatcccatcaataaattccatacaaagaatattgttattggaaaattcttcgtacactttaggaacataggtttctttattatttttaaaattaagccggaactgctggatattgtttttttcattgatgagagaaacttcttccaataaagacttttcaaaagtagaaatggcttgcttcagattcagcttttctccgatttccgaataggctgatatcagcttttcaatgtctttaatcaaaagcaaatcatcttcaataacagactgcacatcaggctttcttaattttaatatcaccgggctgccgtcaagtaaaatacctttatagacttgtgcaatggaagctgtagccaaaggttccttctggatttcgcggaaataatccttaacagaaatattaaactcactttccagtgcttcctctacattcatatctactgtttccactttatcctgcagtttctgcagctcctgaatcatttctggtggcaataaatcttccctgttactgaatgtctgaccgagcttcacaaaagtaggtcccagctcctcaagagccaatcttattctttcataaacggttccttttgaaataatttcatccgaactgcctgaaatgtcttcctgcttatttcctccgttcattcttgccagcatatctttaaatccatatttactcaatacagaaatcagtctcgcggatcttttcagttttctttgtggcttgtcaaacatagtgtattaatagtaggttcaatgtactccaaaaattgttcctttatgaaaagaattattataaccatattgcaggataaaaattaaaaaataataacacacaatcagtattttaaagaataaaatacaccaataccaataaaaacatatcatatattataaaaattaatatatttacaacgtacaaattaacaaactaaagtattaaaacatgaaaaatttacgtaacaacaaactttcaagagagcaattaaaaggaatcgcaggaagcggccttagtggtatcattattccaaactgctctaacgagtgctgtcctactgatggaagaccaagatgcccaagactgatttgtcctgcggtagtttgccctcagtacgtttaatgtattttaaaaattttaggtaaaaaataaaaacagaatgcaattgcattctgttttattatttaagataggtctcatagagatctttacgacggtctttcattacctgcacagaaccgttgtgatgaagatcttttaataaatttaaatctacatctacaattaaagtcatttctgtattgggtgtagcttctccttttactgcattggatgggaaggcaaaatcggaaggagtaaatacggcagcctggccgaactgaatatccatattgtttactttaggaagatttcctacacatccggcaatcgcaacataacattcattttctatggctcttgcagcggcacagtgacgcactctcatataagcattctgagtatcggtcagataaggaacaaacaggattttcattccctgatcggctaaaattcttggtaattccgggaattctacgtcatagcagattacgagacctattttaccacaatcggtatcaaaaaccttgatttcatttcctcctttcatcccataatatctcttttcattcggagtaatatggatttttctgtattcgtccatacgtccgtcacgatgaagaaggtagcttacattatacagttcattgttttcaaagacaggcatgcttccggaaataatattcacattgtagctgattgccagttcagaaattttattcttgatctgctctgtaagtttcgccagctctatcatactgtctctttccgaaaggttgttgaaaggggccagcaaaggagtgttgaacagttccgggaacagcacaaaatctgatttgtaatctcccatcacattcacgaaaaattctacctgctcataaaaggcatctatatccttgaagtgcctcatctgccactgtaccaatccaagacggataatgctgtcctgcatggtattcggtcttttgctgtaatagatattgttccattgcaaaagcactgcattttctctggaggcttcatcttccggaaggtattttttcagtaccctgatcggcaaaaaattgttggaaagctggaaagacagtaccggatcatagatttccttatctctcactttccgtatgtattccctgggagaaagctcgtgactgtatttgtgatagctcgggattcttccaccaagaatgatagattttaagtttaactgttcgcaaagttcttttcgtgcgtcatacagccttcttcccaaccgcagctcacggaattcagggtctacgaaaacttctattccatacagaacatttcctgtggatgaatgggtgttgaaggtatagtttcccgtaatatcgctgtaggtatgatcatccccgaattcttcataattaacaataatggaaagtgctacagcggccagcttcccgtcaaccgtgatacaaatttgtccgttggggaatatttttgtgagtttatcaatactttttttggaccatatagattccgacatttgcggataggcccttttcatcgtttccgccagttcatcataatcctgaagggtcaggtttcttgtttctatttgcatttgatgtaattttacttaaatttaatgaaatttgctttaataggatattacctatcaaaacattaaccaaacattaattcggaatggcaataatttttctgaatcaaagcgaatgtcccgtttgtaaaaaaactttagataaaggacaggatatagttttatttcctcctttcacctcggacaagaatcatcaattttacttatttaatgatgaaggagctcatcgttcttgtttgcagaaaacaaaacttggaacagaagctttaaaatttttagaaataattctccgatataaataaaaaatcccacccaaaagggcaggatttatatagtaaattcaagtcaaaattattcccactcaatagttgcaggcggtttgcttgaaatatcgtaagctactctgttgattcctctcacttcgttgatgattctgctggaaacagtatcaaggaattcataaggaagtctgctccatgttgccgtcataaagtcgatcgtattggcagaacgaactacagctgtgtattcgtaagttctttcgtcacccattacccctacagattttacaggaagaagtacaacaaatgcctgagatactttctcgtaaagatcatttttgtatagttcttcgatgaagatatcgtcagcttcctgaaggattctcactttttcagcatctaccgctcccaatactctgattcctaatccaggaccagggaaagggtgtctgtataccaggtgatgaggaatacccaattcttctcctacttttcttacctcgtctttgaaaagttctcttagtggctctaataattcgaattccatatcttcaggaagtccgccaacgttgtggtgagacttgatcactgcagatggtccgttgacagactggctttcgataacgtcaggataaatggttccctgagctaagaatttagcgccttcaattttgtgagattcttcgtcaaatacgtggataaattcgtttccgatgatttttctcttcgcttcaggatcgtctactccggctaattttgaaaggaatctttctttagcatccaccattttaatgttcatatggaaatgttctccatactgatccattacttttttgccttcatcttttctcaataatcccgtatctacgaagatacaagtcaactgatcgccgatcgctttgtggatcaaaacagccgctacagaagagtctactcctcctgaaagaccaaggattactttattgtctcctactttctcacggatttcctcaactgttttttcaatataattggtcagtttccagtttttctctgcattacagattccaaatacaaagttttcaagcattttccctccttcttcagtatgggaaacttccggatggaactgaacgcagaaaattttcttatcttcattagagatcgaagcaattacacctgatttcgcatttaattcaaaacctgcaggcaattctcctacttcgtcaaagtggctcatccaaacaacagagttctgagtcactccttttaataaagagctttctttaacgatctctaagttggctttaccgtattctcctttctctcctttgtttacttttcctcctaaaaggtgagccgtcatctgcattccgtagcagattcccaataccggaactccctgctcgtataattctttttcaaccaggtgggcattttctgcatttacagaacttggtccaccggaaagaatgattccttttggctgttttgctaaaatatcttgtaatggtgtattgtaaggtaagatctcagagtatacgcccatctcacggattcttcttccgataagctggttgtactgggatccgaaatctaaaataataataccgttgttcatttttgataattgataaatgatgattgataaatgatagagcttatggcggctcgcttatgactgatggcttggagatcactccaaattaacctttacccaactcacatctaacctctagcttctaacttctaattattaactgttttacaaaaaaagacttggaatgactccaaatcttttttcgtgatttttattgaaactttccgatgtcttctctgtagaagccgtaatcgaaatgtacgtgagctgcgtcttcgtatacttttttgcgggcatcttcataggtagctcctgtagccacaatgttcagtactctaccgccattggaaaccactttgtcacctttactgatggctcctgcatataatagtttactatgcttcaacttatcttctcctgtgatttcgaagcctgtttcgatgtttctaggatatcctcctgagcacattaccagacaaacagctttttcgtctttgaatttaagctcgatatctttaccatccatacagtcctggatcacatccaaaagattgttttccaaaagagccatcaatacctgtgtttcaggatctccgaatctcatgttgtactcaagaaggtaagctccgtttttcgttaccatcaatccgaagaagatgatccctttaaatccgaaaccttcagcttttagtccttttacagtaggctctaaaatatttttttcaaaatctgcataatgttcctgagtaaattccggacttggtgctactgatcccatacctcctgtattaggtcctgtatcaccatttccagcttttttatagtcttttgctgctacacatgggaatagtttttcaccattagagaacgcaataatagacgcttcaaaaccttgtaaatattcttcgataactaaacggatacctgcatctccatagattcttctgatcataaaatcatgaatcgtagcttcagcttcttcaagggtatcacaaataacaacaccttttcctccagctaaaccacttgctttaacgactaaaggatactgctgtgtctttacatattcgatcgcttcgttatatgaatcaaataccacagctttagctgttttgatatcataggtctgcataaatttcttagagaaagctttacttccttcaaggcttgccactttctgagtaggaccgaaaactttaagatcgtgctttttaaactcgtccttgatacctgctacaagcggtgcctcaggacctacgatcgtaagatcaatcttttctttaatggcgaaatctctaagttctttgatttctgataaatgaacatttttccctattacatcggtagtagcattcccgttggcaaaaaacattttagaaattctcgggtcattctgaagctttgccgctaaagcagattctctaccgccttcacctatgattaatattctcatactttatttattatctagtcttaatttacaaatatataattttgaatgctaaaaatacaatccctgattattttttaattctattttaattagtggaaaaagtgtctgacacctgtaaacatcatcgggattttgtgctcattggctgcctctatactatcctgatcttttacacttccacctggctgaataattgccttgataccttcctgagcgcagaagtctaccacatcacggaaagggaaaaatgcatctgaagccagcaccagatctccggagaatttttctttagctctttcaatagcctgttgcgttgcccagattctgtttacctgtccgccaccgataccgaatgcctgaattccgttggaaactacaatggcatttgacttcacatattttactactctttgcgagaaaagtaatgcttttttctgttcttctgttggctgcacttcagtaactactttaatatcgtcagagaagtgggtatcattatcctgaacaagaataccaccgtctaccttcacccatgtctgtttgtctgaaacagggtttacgattctgatgattctcaggtttttcttttttcttaaaatttcaagagcttcttcatcaaattcaggagccattacaatctcaaggaatgttttgttcagctcttcagctgttgctgcatcaattttatagttcattgcaacaattccgccaaagatggaaaccggatcacattcgaatgttttcttgtatgtttccaatgctgaagtcccgatcgcaacaccacaaggagtagagtgttttacggcacagcaagccatttcttctttgaactcatttactactttccagcaaaggtccatatcacgaagattattgaaagaaagttctttacctccaagctgttcgaagtctttcatggctccgttctcgaaagtagaaacatagtaagctgccgtctgatgagggttttccccgtatcttaagtctgcaacttttttataagaagcattaagataagcaggatagtcttcatctaaaagcattcttgaaatagctgcgtcataagcagaagtaaggttgaatacctttcctgcaagctttttacgggtttcaatgtaagtatctccgttttgctccatttcaattttcactgctgcataatcctcaacatcagtaattactgttacggaatcaaagtttttagcggcagaacgaagcattgacggacctccgatgtcaataaactcaactttctcatgtaaagaaatgtctttgtttacattctcaaagaaagggtaaaggtttacgattaccatgtcaatcagaccaattccgtgctcctgaacggttttcatatgctcttcgttgttacgaacagccaataatccgccgtgaactttaggatgcagagtcttcactcttccgtcaagcatttcagggaaattggttacctcatcaatctgaataggatttaaaccagcgtctttcaaatgtttgaacgttcctcctgtggagatcaactcataattctgagcttccaaaaactgcgcgaattctattaatccacttttgtcagaaacactgattaaaactctctttttactcattttactttcaattttttactttttacagctatttcaaactgtgtccgggtctttcacctccggacttacttttattttttacttagatttctttttattattaaaactgatctttaattaaaactttaaaatcagattattattttggtcataggaaaatttccactttccaccattttctccccacttgatattattttcgtcatataattcagtttttatctctcgataattattttctgaaaggctacgataaaaaaaagtgtctagcaaacccaatcttttaaaaggattcttggcattatcataatcaaaaaaggtaatttctgctctagtgcttttattttcattataatcattcaaattctgacgcactattttctttaaatttgccccttcatatatgagtatatcaactttctctaaaaagccaagtgaagaatagtttggagtcccaggagtaatattgggatacttcaatgtaattttagtcaatttaccatcggaactatactcgtaataatattttcttacatcatagatattaccaccatctggaacaggaatatatttttcaataactttcccattactatttaaaacatatctaatagttttaggagtaactgaactcccatcatcacttttattttctacaacaacagtattttctatatatgacagatttgtatatattggatatatgtacccataatctttcctagcttttataagccttccctgactatcataagtaaacaattgataataatcgtgtagtggattaggctcatcttcatcaaagccgacaattgacttcagtagtttatcaggacttaaatcattagcactaatctccatgtttacttcttgagaatcctcattagaagtacaggaagacaatgttattgatattaatattactattaaaactgttttattcatatatgattttacaatcattatttagtttttaaaactttattgatcgctaccggaaaaatttcatattcaatctggtgaactttctgagccagcgtttcaggagtgtcatctgctgtcacttcaaaagatttctgaagaatagcttctccctcatcaatgcccggcgttacaaaatgtacagtcgccccactctctacttctttggcttcaatgactgcattgtgaacgttcattccccacattccttttcctccgaatttcggaagcaaagcagggtgaatattgattattttaccattccagttttcacagaattcagattttaaaatggataagaatcctgccaatacaataaggtctgtattttcagggattactttggccaactcgctgctgaagttctttcctctcggaatgagtatgttttctatattatgattctttgctctttccagtccgaaacattctctgtcagctaccaccaaagttacttttgcattctggatttctcctgagtcaatagtatcaatgatcctttgcagattggttcctgaaccagatacgagtacaacgatgttcttcatattttttgtaaaatgtaaaaggtattcatgtattaatgacttccaacatcatgaatacattttacgttaatacatttatacagttaagtttattttctctgctccttcagtgatttctccgatttcgtaagcatcatctaaaaggtgtaatactttttcagcatgctcagcatctactacaacaatcatccctacccccatattgaatgttccgtacatttcctcacgtgttactccacctcttttttcaagctcaagcattacactaggaattctgattctggatccgtcgatagatgcgcaaagaccttcaggaataattcttggaacgttttcgtaaagaccacctcctgtaatgtgagcaattccgcttacttttacttcttccaatactttatggatatctttataatatagtcttgtaggaactaaaagggtttcatataatggttttccttcaaactcttcttcaaagttcgggaatacttttcttactaaagagaatccgtttgagtgaaatcctgagcttggtaatgcaataattttattaccagccttaatggtagaaccatcaataatctgatctttttctacgattcctacacagaatcctgcaacatcataatctccaggctggtacattcccggcatttcagcagtttctccaccaatgagtgcacagttattatccttacaagcttccaccattcccagaacaatttctgcagcaatttctgaatcaagttttccacaagccagataatctaagaagaataatggtttagcaccatggcaaagaatatcattggcacacattgcgaaacaatctacaccgatagaatcatattttttggtatctaaagctactttcagcttggtccctactccatctgttcctgatacgagaaccggatttttgtatccgccgatttcatagaaagcaccaaaacttcccaagtggttcaatacattggaattgtgggtttcaccgaccgcttttttgatcttgtcaaccgttttgtatccttcttctttgtctactcctgctgatttgtaagtgttgctcatgtctgcttagatttttagatttcagatttcagatcttatactatttgatctagtaatggtttccggaatcttattatcttttaatatttcaattaacttttatactcaattttagaaaacaaaaaagccgaaaatcttttcagattatcggccgttattttatctcagaatttcagagcccacaactttccctttatgagaaaaacattgtttataggaggtctgaattttcatctcttttctttttgcaaaaatagtaattttaaatgaatattcaaattctatttttcaaggatcgtttcaatagccgaaatcttcttaattttctcttttaattcactgactttctcttcgttagagattttttgagtttctttatcaaagttatcattgaagaaaggaagtgaaaaagtatccaccacatttcctccatggaaaggaaaacgttttgatgcagcttccaaaactccagctccacctctgcctcccggagatgtagacatcaatagcattggtacttcattccaaacggttctgtctttgattctggatacccagtcgaacacatttttgaatgctgtagaatacgttccgttgtgctctcccaaagaaaccagtaatacatcagctccgtcaatttttgctgcgaaatcatgagcttcctgaggaaccccattagccagttctctttcatgtttgtagataggcatttcgaaaggatttaaatcgatcacttctacttctgcattttcaaataatgttgatgcataggctaccaactgcttgttcattgaaacttctgagttacttcctgctattgctaaaattttcatataggtgaggtttattttttaagattacaaatttagttttttatttaagataagacggcagttccatcggtacttccattaataatacttcagtgtcttccacggcttctatattaaagctctgagtgtcccagattcccaatccgtctctttcgttcagaacacggtccccgatttttgcacttcctttcagaacaaatgcatacactccgtttcctttcttgttgagcatataatttttaccatttccttttttaaagttggccagattgaaccaggcatcctgatgaatccagactccgtcatcatttttattaggtgataaaatctgttggaatccattgattttttctccttctttaatgcttttctggtcgtatcttggttcaacattaagctctttcgggaaaatccatatctgaaggaattttacttcctcatctttatttttattatactcactgtgcataacaccggtaccggcgctcattacctggatttctccttttctgatcaccgcagtagttcccatagaatctttatgttcaagatctccttccaaaggaattgaaataatttccatgtccttgtgcgggtgtgtcccgaaacccattccctgagaaacggtgtcatcatttaatactcttaaaactccgaaatgtgttctgtctctgttttgatagttggcaaaactgaatgtatgataagaatttaaccacccatggttggcgtggcctcttgaatctgctttatgatatactgttttcattttctgtgattatttatgatacaaatgtacggcatgcagatgtttaaatagttgatgtaggttaagaaaggaaatttggaagtaaaacagcaaaaatgcaaaacagtaaaaatgctgtgggagcaagtaaaatggttcttttatagttggactgctcaaaaacacgattttatattctatgatgtttttaaggtgcaaggattttatctgtgataaaattttataaagattgatggcttgaaccaattgtataaatgcaaatacctgtgttatctgtgaaaatctgcgggagattattatattctgaggatcaaaaaaaataaatatatgaagaataaagtttatttcggctaaagccattgatgagtgcttaaaggaaaagcgggctaaagcccgcttctattgaattatttatgacttcttatttttaaaaaagaattgtagtatagtctgtattataagttcttgtttctatattgagtttatttaaaagcatttcggcttcaagtcttatatttttccatgtttcatgctcgtctaggaaatcccaatcccatatttctacaggaatatcctctacattatttttaaattgtagtaaatcatctttgagtgattcattaatccgtttatttctaaaaatagtttcaaataaaacaggaatgaatgcataatgaagttcttcgtacaattctgctaatgggtctattaaaatgggtgccatttcatccaattgatctacattataggtataaagaatcaatgagttgacgatatttgtataatagaaatctacatgtttatcgcattcaaataactcttcttcagtaaagccgatatcttctaaattttcagtaacgtttatattttcaagcttattcttttgttttgtagtcgaaaaataattcttaaaaaaattaagcttcatgataataattttaattttccctcattaacaaaaataataaattttggctcctatgtttgcaaaagaataaatttacatacaaagcaaaaggggtgagagaacagttttggctaaataactcaggaagtatattgtattgtgctttagaaatgtcctcacttctttatt

SEQ ID NO: 22 - DNA, 17328 bp, Chryseobacterium sp.
gacagattttgaagaaagtagggtaaaaatcaaagaccttcaccctacgcaagctaactcaaggtcgcttttataaatataaatgtataaaaaatatttggaagttaacacagaatctaaagccaattgatgaatatttaaaggaaaagcgggctaaagcccgctcctattgaattttattatattattagatttaaattaaagttttcaacgcaacttctaatttctaacttctaatttctagttaaaaatgaacctgcttgatttcttcttcaatttctttaggtgtttcatcctcagatttaataaaaatcatggtcactacagccccaatgagcatacaaacaccccctaccacaacataatccatggcctgttttccaaaaatcccgcttacgacaggacctccgaataaaccattgatgatctgcggaattactataaagaaattgaatattcccatataaacgcccatttttctctgtggaattacctcaatgagcattgcataaggcattgccagaatacttgcccatgcaaaacctaatccgatcatagagatccataaattgttgacatctttaatgaaatacattgatatgagtcctaaccctccacacaataaggctaaagcgtgagtctgttttttaccgatcagtttagcgataggtgttaatagaaacgcaaacggaatcgcccagagattgtacattccgaaaagttttccggtaaggtctccagcatcgttaaatgctttggaatgggtgtcttccggcgaaagtccgaaatgatgagtggccagagcactggtggtgaacacccacattgtaaataaggcgaaccatgaaaagaactgaacaattcccagctttttcatctgcgaaggtattgctgcaaagtctttaaaaatatctgaaaatctggattgatgcttttctacttcttttccatcttcaaaatcagcaaattcctgtggggaatactctctggttgtcatgatggtatacagaatagatataataagcaatgctgcaccgatataaaaagaataaataacattatccgctacaaatcctgccggtgcttcattggaaatccccatctttgttaaccaatctggtaaatatgaacccagtaccgccccaattccaattaaaatggtttgtaccgagaatcctattgttccctgatgcttaggaagcatatctccaaccaaagctctgaaaggttccatggcaatattcactgaagcatccatcatggcgaggaatattacagctaacaaaagcgcattggcagcaaacatctgagtaacagaagctgcattcggaagtaaaaccaatcctattgcgcacaagacggctccaatcaggaaataaggttttcttcttcccaacggactccatgtattgtcacccatatgtcctatgataggctgaatgatcaaacctgtaatgggagccaccagccagaaccaggatagctcgtgaacatccgctcctaaatttccaagaatacggcttgcatttccattctgtaatccgaatgccatctgaattcccaggaatcccatgctcatattgataatctggagcatggataggtctggttttttcctttttcctaccttcccagtatcatatttccccatcattattgccattacgatttcagtttttgaattaatgcatcttcgataggtgctttttcagtaaccactttatcaacaacctcattaggaacagtcatagaaagaacatactgttttaccttccagcttccattgattttctcaaccactccggaacctctgcaaattttcatctgggtatccagtaattcatcaaaccatgccagctttccgtctttgctgaagtaaatatttcttttaacggctttaaagttccaggttttctttttgtcgaaataaggttttgcccacaccataaatgcttttttatcccagatttcggtagcatctgttccgatgaaggtagattcatccgcaaacagattaaaataggcattataatctgcttttgccgcagctgcattgaaggtatcaagcatagaactgatttccgatttttctttttcaaatccggttttcgactgtgctgcaagtaaggaaaatcccagtaaaaaaaggattagtgaataagcagtcgttagttttttcatatataataattatttttcaagttcaataatcaatggagtttttgcaggaatgttcatactgttttgcaatggaatttctttgtctgaaataatttcttttccttttgtaaatccattcagtgattctgcaaaccgtttcagatctaacgtctggtctttttcattattgttgatgatgaccattacactttctttttcattgtaccggaaatacacaaaaacaccatcctgaggcacgaaatttttagtttttccattatgaatcacatctttgtcttttctccagttcagtagtttttgagtaaactggaaaaattctttctgttccggagtttgagaggatagattgaaagcattttgtgtatcagatttccatcctcccggaaagtctctgcggatatcagcatcgccgccagtctttttatctcctctcattcctatttctgatccgtaataaatctgaggaattcctcttaccgttgaaatcatagtaagtgccattttataagcatcaggattggcgttaaagatttcattccatctttcggtatcatggttttcaaagaatacgagaagattgttgatatccggatacagaaaatcacttgtaaaagagtcataaaccctgatcattcctttatcccagctttccttttcactcagagccttaggcatattttcaaagagcataaaatccatcaccgatggtaaatttgaattgtaattttctatcgccccgatcttcgaatttttctgccacgctgcaatttgtgctgctgtatacagccatgtttcccctacaatattgaattttggatattcatctgtaattgctttagcccattttgccatggcttctttatcattgtaaggataagtatctacacggaatcctcccagttcagcatattcaatccaccagatcgcattttgaatcaggtatttcaggaccaaaggatttttttggttgatatcaggcatggtcgtatcaaaccatccgtccaatgcatattttttatcaatatcagaggcattggtatcaaattgcgttgtcgttttatagttggaacgtttaaatcctttttctccttcatcaaaccagtggatccagtcttttgaaggaagatctttaatcatccagtgtgatcctccccagtggttggttacataatccattaccagcttcatatttcgtttgttcagttcctgggataactttttatagtcttcattggttccgtagcggccatctattttatagagatcagtttgggcatagccgtgataggaatatactttttcgttatcctcatttacaggcgtaagccacaccgctgtggcacctagattctgaatataatcaaggttgttgataattccctgaagatcccctccatgtctgccattgggtaggcttcggtttgccttttcggtaagttccggttttgaatcattcttttcatcaccattggcaaagcggtccggcatgatcaggtacataaagtcttttgaagtaaaagactcacggttggcagatccgggatttctttgttttaattcataggtgtacgaagcaagattcttcttaccttttttaatattgatgataaacttcggaatgtttatttcattggtatcaaccgtaataaaaacataattgggattatctactttccggatgtctttaatctgtattccatctgaaagccaaatctcgtggttggcgacttcttttccataaacaagaatctgaagttcaggatttttcatccctttccaccagaatgccggctctactctttccagatttttctgggaaaaagctaaagaagcaatcgaaagggcaaatgctgcatatattgtcttcatattagtgttcaatttagcattaaattttcatatacacattcaaaaatatgaaggaaaccttgttttttagtctataatcttataaaatatgaagatgaaataccttcatttcgaatttaataaagaatatttaacttttttacaaaaaattcatatttaaaatcagttttaactgctttttatttttagttttatagaaaaaatgttggatttcagtaatatgttcaaaacggaaggaccggatgttgtctacacatggaccattcctgtgtttgctgctattattttcatagagatggcttacagtcacttcaataaagagaaaatctatgaaactaaagatgtggcaacaaatgtcctttttgccttgcttaattatggattggatatcatcatgaaaggtttttccttatttgttatgatgtttttttaccagcatcgtctttttgactggcaggaaggaatatggtactggatagcagttttcctggctcaggactttgcgtattatgttcatcattatgtagatcatcattccagagttttctgggcggtacatatcacacatcacaattctgactatttcaatatcagcacgggattcagaagtcctgtatttcagccattgtacagatatctgtttttctctccgttagcatttatgggctttcatccgtggcatattctggtagcttattcttccatacagatttatggtacttttgttcatacccaatccattaaaagtatgggatttctggaatatatactcgttactccttctcatcacagggtacatcatgcatgtaatattaaatatctcgaccgcaatatgggaatgggcctgattatctgggataaaatttttgggacatttgaaaaagaagaccctgaagttcctgtaaaatacggcatctatcctaaaatgcagtcaaaagatccggcaactacgctattctatgagtggcgaagaattggaaaagatctcagacagccggggatttcttttaaagatcgtatcaaataccttttttattcaccgggatggagacatgacggaaccggaaaaacggtaaaacagtaccagaaggaatataaagaaaagaaaaaaattcagactccggttcaggtaaaagaactggtatcagaatctgagaagcaatatccccaactcattcaacagacagaggataaataacaaaaataccccggaacattaaaaaatcaatgaaccggggcaccttagtgtatcttaaaaaattattttactggcttaattgaaattgcgaaaccgccgcttcttgccattttaaaattaatttttgatttacctgtaatctcttttttatagatattatagctttgaggattattaatataatcagcatcttttccatcttcatagatcgttgcttcatatttctttcctttatccaggaatgagaagtctacagtgtattcacgtttgttttcatcggtaatacctcccacaaaccagttttcagtacctttcgcttttcttgctgttaccacataatcaccaggttcagcagccaggatttttgtatcatcccaatctgctgccacatccttgataaactggaatgcatccatatgttttttatagttttcaggaaggtctgcagccatctgaagcggcatgtacatggtcacataaagcgccagctgttttaccaatgtagtttttacgaaacggttatctccagggaaataatagtctagttttgtctggaaaattcccggcgtgtaatccatagaacctcccatccatcttgtaaatggaagaactgtctggtgatcaggtttatttcctccgaatgcttcatattccgttccacgggctgcttctgcagagatgtagttcggataggtacggctttcccctgtaggacgtacagattcgtgagaattaaccattattttatattcatttgctttttctgcaattctgtagtaatgattaatggtccattgagaataatgatgttcccctctaggaatgatatctcctacatatcctgtctttacggcatcatatccatattttttcatggtctggaacgctttgtctgcccatctttcatagtttgttgcagaacctgaagtttcgtggtgcataatcagcttaattccttttgaatgcgcatattcattcaacattttgatgtcaaaatccgggtaaggtgtaatgaaatcgaaaacaaattcttttgaatgtccgaaccagtcttcccaaccaatattccaaccttcgatcaacaatccctggaaaccattttctgcagcaaagtcaatatattctttaacttttgtattgttggctgcatgttttccgtttggagtaagctttgtaaaatctgttttacctaaatgtacattttcagcagtagaatatgcccactgagattttccgataatcatttcccaccagacacccatgtattttgtaggatgaatgtaagaggtatcggtatattttgtaggctcattcaggttaaagatcattttggaatccattacctgctctgctttcggcgctacaataattgttctccacggagttactgaaggagtttgaatatatcctttcgctccttgtctgtcggctgttaagtgcgttttgaatttataattctgtgcatctacttcaagatgtgaagccggataatccaatacagcagcttcagcaacgttgatatacaaaggctcttttccttcttttttaagcattaaaggagactgaactgcgtttttcaccaatgactgggaagcatttgcatcgtatgccttgtcccattttgaaggaatctcagatacttttgtttcctgatactgatattcctgagaatcatagtctgccacgatccaccatgctttcatatcggtagggaaatcgatttcagagtcttcttctctgatcacaaaataattaagatttttctgctgcggaaattcataccggaatccaagcccgtcattaaacaatctgaactttaccacaatgcttctgtctgtagaagcctggttcaaggtaacagccagctcgttgtagttattgatataatttttcttttctcctaaaaccggctgccaggtttcatttttggagtctcttttttcatctgtctttgcaaaaccgttattcagatcgtattttgcatcttctggtttggcaatctcagaagcgaactttatagctgtgtctttaaataatctcaatcccaatttagaatcttcaaccactaccgcaccattgtatttcaagttgtagtaaggtactccttctttcagctgaaagttcatttcaaacttcccgtccggagattttaaagattgggcttttacacctgtaaacatcattgagagcaaaagcgctccaactgtaattttcttcataatgactatttattaacttaaaaaatagataaagtactgcggtaaagcagcacattacctatttttattatttcttaattattataatgcttctattttatatgtacctaatttcaggtctaccgaaattttgtaacttcctcctgttccatcaaatttaatgtttccattacttcctttaggagctataaggcctgagtttccgtctccggagatatttccccagtcaagatctccccaactctgttgacccaaaaatttaaattgagaacccgcaggaagcgtaatagtatgttcaaacttacctccgcctaaattggtcatagggatagctccggctgcattccagccgttaattgtacccaccatataaagattagcaggattccagttgttgattgcagaaggaactacatctatagttttcttagcaagatcagaatcgatagtaattttgtacattcctgaagctccggtgaacaaaatattttcaggcgcagcagctgccagattggatgaccatgttttaaaatatttattagcagtctgcattcctgatgtatctaaactataatttaaagggctccaatctttctgtcctaaaaatctgaatgcttttccactttccagatatgtataaattgtagaaatattttcatttttatataacatctgggccgctcctgcattccagcccactgcagatgcttctcctacaatataaaaagaaggatattccgtcaggtaaggagtaatcgtcatcggaattacattagaataagatactacagcatttcctacagagaccttcattcttacttcaatatttgcggcaactccaggaaggaaccctgcatcaagaataattttatttaaatcttttacagtaaaagttctggacagatcacctgcagtcagatctgcacttttggcacccgcaaaacctgttcctgctttagcgaattcgagagcattgctgttaacaacagccagattaaatacaggatttgtccaagtaaattttactgatttatcattttcattagctttaagcaaaaccaatgtagtggcatctcctgctaaagtaggcttttttgtcacctcaagcaccgccttgtcttcatctttttcgcaggaaactaccaaaaatcctaaaacaaaaagcgtaaatattttgaataaatttttcattgtaatcaagttttaaattagtacccaggattctgaatcagattaggattggctacaatatctttggctgggatcgggaaaagatttctatagctttctacggctttcccttctattacatttcctttccacggccataaataatctcctgttgtaaacttgttgaaacggataagatcacttcttctggtcatttcccaggataattctctggctctctcatctaaaatgaaattcagattgatagaagaaacgtttccgcttgtatctccataagcacgttgtctcagctgattaatataaccgattgctgttgcctgattaccaccagcacctcctctcaacacagcttcagcatacatcagataaatatcggctaaacggtataacgggatatcagcttcgacccagttaggatgagccccagcagatccgttacttttaacattcttaaatttgataaaggcataaccatctgtaaatgatcctaaatcattaatttctaaattctgtcctgaggtaaagaatcttcctcttttatcacttccattagctggaaacaacccaacaaatgcttttgtagttcttaaaccactccatccgccattcactccaaagtcagcagctttcatatcacctcctattgcagcgtgaacaagataagttgttcccccattggtttgtgtattaattccgtcaaaatttacgcttaaaatctgctccgggttattgatattattatcagcaaggaacaaatcgtcgtatttaggttttaaagaataccctgctgcaattactttgttacaatatgtaatacagtctgtattcctttgggttcctgtataaacttcagcatttaaatataattttgccaacaatgcccagacagcagctttatctgctctgccatactcatttgttttaggatcttttaattctcctgctacagcaagcaattcagattctatataattaaataatgcttttctttctatcctttgtggcggattgacagatcccggcaagtatgattcatcaacaaaaggaacatttccgaacatatcaatcgcatggtagtatgattgtgctctcaggaaacgcgcttctgctctcatcaattttgcctgagtaagattgtctcctgtaatattattggaagctaatttttcatcggtaacatttcttaagaattcattacaaaaagcaatttctgtatatattctataatacatagccgcaataaactcattggaagcatcccatgtcattttgtgaagcgtatgaaggtttccgtcattccatcctatgactgcttcatccgttgttacgacattcaaagtgtacattaatcttgtatattgagaaaaaccaccgttgatcccattaatatcactatccggctgatcaccgtctccacttacctggccacccatagcaagacctccgtaaagttttgccagaacatttttgtaattggcaaaatctttataaatactggctgaagtaacgtctgtgataggttctctttcaagatctttcacacaagaagttgctgtcaataaaaatactgcagaaagaggcaatactatattttttagtttaattctatttagtttcattgaattcttatttaaaattggaagttaaaacctaaagaataaatcctaggcatttgataataaccgttatctattccaccaaaaacttcaggatctactccagaatatttagtgatcacaaaaacattttgtgccatcgcatatattttcagattacttcctttagaaaaaacttctccgaaattgtatccgacattaatattatccagtctcaggaatgaagcattctcaacgtaaatatctgatttatattgaggaacagaaaattgatattgtggtgctgttgcaaatacgttttgaagatattcatttgtggacgccgactgcagtgaactgttggatgcagcattattatatacatagtttcctaagacagctcttgcacttaatgcaaaatcccagtttttatgagatacttttgtagagaaacctaaaatggcatcaggtgttgtggatttgtaataatacatatcttttgtattaattaccccatctccgtttctgtctacataagctccgtcaactggctttccattggtatcatatacttgttgataaacccagaatgaatttggtgcatatcctacggcatgagcctggatcctgtttcctgaacctccttcaattccacccacttccatattgaatgattcatcagctctgtctttaagcttagtaatcaccggcttgtaatgagtagcattaaaacttacttcccaggttgtattttgatttttaaccggaattacagtaatacttccttcaatcccttcatttttcatatctccaacattttgccagcttgcattacttaaacctcctgcaggttcatcagcatatacaagaaggtctttagtatcttttctgaaaatatctattgatcctgtaattctgtttttattaaatccaaaatctaatcctagatttttagttgttgttgtttcccaagtcaggtttgggttataattagcaggtctgaacataaaatagaattcatttccaaactgataccctgctccctgatagctggggttataagctgcaaacgccggatagttattaggtttattaccgttcaaagctggcaattcctgctgacctgtttttccccatcctgctcttaattttaaagtactgatagcagatatgtttttaatgaaactttcttcattaagtttccatgctaatgaaaccccagggaaaactccccatacattatctctggttccattaaagaatcttgaagaaccatctttacgaactgatcctgaaataacatatttattagctattgtaaaaatagctcttccatagaaagagatcaatgtattttgagttttgaagtctaaatcctgcgagttaattcctgttcctctataagtgatagctcctggaagataaatattgaaatcctgataagaatatcctgcagtaatatctacaccagtattaatggcactgatatttttcacataattaaagtaggtctccaaaagcttgtttttcttttccatagaatagaaatttgagcttcctttatcttcaaaacctggtctcagacgggcatctttaaatttatgtccatcactttttgtataatcatatccggcatttacattgaaatgaaggtccggaaggaagtgaaacttataatctaattgaatatttcccaatcctctcaatacagaagagacatctcttaccccattgatcatcccaagagggtttgaattggcatttacattataacctgttgcagatcctgagtccagccattcataataccctccataattagagtttcctgaatatacaggttgtgtaggatcaaaataagtagccgccttaatcactccaccatctacaaatctattatctgtaaatgttccttttgcgtttacatttactgataaatgattatcaaagaatttagggtttaagttcaaccctaccgaggttctgcggaaagaatttgattttacaataccgttctgctcattatatcctaatgataaacgatatggcagacctttaatacctcccgaaagcgcaacgttattatctgtaccccatgctgcctgataaatctgatcctgccagtcggtatcagcatttcctaacttagttttataaccagcaggagcatatgtattaacaaaatctctaaactcctgagcatttaatacatcaacctttcccattttagtagaaaccgaagtcaccgttgaaaaattcactttgaactttcctgccgttcctttcttggttgtaatgagaataaccccattggaagctctgttaccatagatagcagtagcagatgcatctttaaggatatcaaatgtttcaatatcgttcgggttaattaatgatagagggtctgacaccccattcattcccacaaagtcctgaggaactccatcaattactatcaaaggtgaattctctccacttaaagaagaagttcccctgattctgatttttgtacccgatccaggtgccccactgttattggtaatctgtacacctggtgttttaccctggatcagctgacccgctgacgtagctcccccgttgaagtctttagccgttacagaggttatagagccggtaaggtcagattttttctgctttccgtacccaatcagtacaacctcatcgatctttttctcctgaggaacagagtcctttttctgcgcatgcattactgtactggccagtaaaaaagcgggcgcgatttttaatactgttgtaaaattcttcacaatcttatttttttatagtttcgttttttaagtcttattttagcctaaagccagactcgcaatttaaaaaaaaattagaattattataaatttaatataattttagttaaaattatgtatattacgaaacccattttagttagttttttaagatacaatattttacaacgtcttatgctttacataatatttatttcaatttaagaaaatgttaaacaattgtttaactttattttgagtttgagccttaaaattcgcattctgcatcataataacaccaccaatagcggtattcaacagatattccttatctttgcagtcaaaactttactataaatgtcaaacagaaagatgattacggcagctttgccttatgcaaacgggccggttcatataggacatttggcaggtgtttatattcctgcggatgtttacgcaagatttcagagaagattaggaaaagatgtagcgtttatctgtggttcagatgagcacgggattcctattaccataagagccaaaaaagaaggggtaacccctcaggatatcgttgacaaatatcacgggatcattaaaaaatctttttctgacctgggaatttcatttgatgaatattcaagaacaacttctaaaaagcattatgaaaccagtcaggatttcttcaaggttttatatgaaaaaggaaaattcactgaagaagtttctgaacagtattttgatgagcaggcaggagaatttcttgctgaccgttatattgtaggaacttgtcctaattgcggtaatgaaaacgcttacggagaccagtgtgagaaatgcggtactaccctttctccttctgagctgatcaatccgaaatcaatgcttagtggaaatgttcctatccttaaagaaacgaaaaactggtatctgccattaaatgaatatgaagatttcttaaacgaatggatcattgaaggccataaagatgactggaaacctaacgtatacggacaggttaaatcatggctgaatgatggtcttaagcctcgtgccatgaccagagacctgaactggggtgttccggttcctcttccgaatgctgaaggaaaagtattatatgtatggtttgatgctcctatcgggtatatttccttcaccaaagaatgggcagagaaaaacggaaaagactggaaagattactggcagagtgaagacagcgatctggtacactttatcggaaaggataatattgtattccactgtattattttcccttcaatgatgaaggcacacggtgattacatcatgccggctaatgttcctgcttttgaattcctgaaccttgagaatgataaaatctcaacgtcaagaaactgggcagtatgggctcatgaatatgtggaagatttcccagggcaacaggatgttttaagatatgcacttctttcatctgctccggaaacaaaggataataactttacctggaaagatttccagactaagaataattctgaattggtagggatcttcggaaacttcatcaacagagtagctgttcttattcataaatattatgatggtgttgttccgcaaggtaatgtaaacagccctgaattgcaggaaataagtaaatcggcaaaagaaattgcaggattccttgaaaattatgagtttagaaattcattaactgcattaatgaaccttgcccgttttggaaaccagtatcttcagactgaagaaccttggaaaacgatcaaagataatccggaaaaagcggctcaatctttattcgttggagctcaaatagctgttgcattagctcagttatgtgaaccttttatgcctttcagttccgaaaagctattgaatatgttcaatgttgagaagaaagactggaatattattgaaaaccaatcagtattaattgaaacaggtcacaaaatcaacgaatcatcgcttcttttctcaaaaattgaagacgacgtaatcgaagctcagatccaaaagctggaagacacaaaacaaaacaataaaaaaacaaaccctaacgcaaacccaatgaaagaggagatcacgtttgatgactttactaaaatagatcttagaacagcaaccattattgaagctgaaaaagtagaaaaagcagataaattactgaaacttactgtagatacaggagtagatgtaagaactgttgtttccgggattgcggaaagcttcacacctgaagaggtgatcgggaagcaggtaatgatccttctgaatcttgctccaagaaaaatcagaggaattgagtctcagggaatgttattattgacaacaaaaccagacggaaaattatctttcgtaacaccggatgacagcaatgttgaaaacggtattgagatcggataattagaatccttataaagataacaggctgtttcactagaagcagccttttttttaaataatacttatggtcaataaaagtgttttaagaaagctttccaaccaggaattagaaggatatctaaaggagggcaaccgctttgtaccggaagctgttcagatagcttttgaaattctggaagaaagaggacgtgttttcaatgagcaggaaaaaactgccatacaacaattaattcagtgtaaaaaagaacaagaggagacaaaacatacagaagagtttgaaatctggaaagatcatattacagaagatccggatgctatcaggctttattcacgaatgactatttttgtcagcagtgttctcttcagtacaattcccggtgctattctgctcgcgcttaatttaatcaaactcaaaaaatactttcatgcgtttctttcggtggtatttggcttccttttttttatatttcagaagtacgttctggtttctcattttaattttggtacaacttcccgatacagtcccgaaattggggtcatagcagcaggagctttgagcttacttatcatcagtgttttagcaactccgaaaaagcttccttaccgcgcggaatcttatattttccctatgattttatgtgccggaactgctgttctgatctatttttattttcaggagtggttttcattttatccgctggcaagggttatcaatatattcagacaataataaggagctgattcccgctatccacttttactcctcgcccctggcaaagagccaactgcatgctgtggggtaaccgtttctatcgcggctggaaatagtacaaaaagaccatttataaattcatgagattgcttcgctttcagctcgcaatgacttgttttcgtagttatttcttggtcagctttgccaggtaagcatcttcatccctcaaaactctttctattttaaaaccattatttgtggcagcattcttcaaagtattaaagtcaagatacagccaggtaatcggttcttcagattctcctttataatgaaccacataatccagttcgccataatatccgcctgcaggaatgtatactccaccatccttatcacgatcgaacatataaagaatatctgtactgtcgatcaggatctgtcctttatcattcaataaggtatgcagcttctgaagataggtatcaatttttgctaggctttcaaaaaccccggtgccgttcatcagcaataaaatagtatcaaatttctccccggaaaaatcaagcatattttcacaaaccgcttttttaattcccctcaacttacaaacctcaacagatttgggtgaaatatccaatgcagtcacatcaagatttttttcattctgaaggtataacgaatgagaaccagcccctgcaccgatatccagaacctttccttcggataaatgcagtgctttctgctctatatcattcatttcttcaaaatctctgaataagtaattcaccggaagctcatccagctcggaaattgacgtttcagtctgcagatcttcaggattttcattatgataataatcccagatcgctctgcccattaaatctttcatacgtgcaaagataggtcttcgggatgcaaagttcaaagtttgtgattcaggtttttgagttacgagttcttattgtttttcattaaagcggttgggtgtcattattataacgcaatagatcgcaatttttttttgagatcgcgtactttttaatttcgcgaaggcgtttcactcagcaatgaaacagtaaatatcttagctaaatgaaatgcctttgtgaacgaaattactttcagatcggattaaaaaactttgcggtccaagcgttaaaagaattttcatgatagcatttgggcacattattataacgca

SEQ ID NO: 23 - DNA, 443028 bp, Chryseobacterium sp.
ttaaaagaattttcatgatagcatttgggcacattattataacgcaatagatcgcaatttcttttgagaccgcgcactctttaagttcgctaaggtgtttcactcagcaatgaaagtaaatatcttaactaaatgaaatgcctttgtgaacgaaattactttcagatcggattaaaaaactttgcggtccaagcgttaaaagaattttcatgatagcatttgggcacattattataacgcaatagatcgcaatttcttttgagaccgcgcactctttaagttcgctaaggtgtttcactcagcaatgaaagtaaatatcttagctaaatgaaatgcctttgtgaacgaaattattttcaggtcggcttaaaaaactttgcggtccaagcgttaaaagaattttcatgatagcatttgggcacattattataacgcaatagatcgcaatttcttttgagaccgtgcactctttaagttcgctaaggtgtttcactcagcaatgaaacagtaaatatcttagctaaatgaaatgcctttgccagcgaaattactttcaggttggattaaaaaactttgcggtccgggcgttaaaagaaatttacgctatgtcattgactactgactatttgaaatttattcataacttattttttaattaaaatcctgtttccgatcaagcccagaaacaggatttgaaatataatatgctttcagatcagggtattttaaatcctgatcatttcttaaaactcaaaagtataagacaggttgaatgttcttcctcttcccttataattaaacagttccggaagtccgtaagtggcatataaaacctgggaacgcttgctccagatcgtctgataatcggtattaaacaggttctgaattcctaagttgaattttccccagttgaaatggtatcccaccatcaggtctgaagtattatagccttccaccacattattcagctcgtctttctgcttgaaattctgcagagactgaaatctgaatgaccagttttgaatgttatacccgatataggttaccagttttgaaggggaagcattgtaaatctcctgcttctgccattctcctttgttgtctacttcagatttgatcaaaagtccgctggccccaaaatacactccattacttaaagaataagaaacctcagcttcaattcccatattccttaatttcaaatcattcacaagaatctggaatgtctttttatctacagctactgttttgtcagaattactcaaaaatccggcaatctgagctcttagaccgcctctgttgacacgatatcctacctcaaactgattcgttttgattgcctgtaaaggctgttctttcacattgatactggatacgacatcccagtttgttcctacaagtttatactgaccgattccgtaaaacttggcgggatctgctaaacttgctccttgggaaaaggttccccaaacctgatgctgctcattaaatttgtataacaatccggcattggccaatgttacattataagaactttcaccaccaggaattacagatgctgaacttccatagcccatggcaacctgcgtttgctgttctgaaccaacaaaatcgtccatttttacgttgatatgctgataacggattcctgcattcaactgcagttttggaagaatgttatattttgcctgaacatatcctgcgtaactttgtgaatggttggttgggtacctgccaaggctgtattttgtttcattgattaaacctccgctggacattgtctttgcaatgtcataaacagattgagttccttcaaatttttcaaaatcaaaatctgctccatacgtaacgttcagtccgcgccatgattttgataataaagctttaatcccggaataataagtatcctgctgggatgaggacatgtatggtattttacctgtctgtaaagtaacatttcccgggaatggataaaatcctaatttttcgccgcgggttgccagctgtacatataggtcctgtccgcctaaaataccatttccgttatatgctacggttgccatataacgttctgttcctacatttttatcggatgagaagccatctctcatttccagtaaagaaggattttttgtagtaaaggcacttaagttttcacctaaatataaacttctgtctccattaaatttagaattgtaatactgaacagaggctgttattttatgtttattgttaaactggtaaccacctgttgccaggatatcaaccgactggttatactgaaggtctgtctgggtaatatcggtaaaaagctgtttctgatctgcaccatacactccaccattctgctgataagcaactcccagtcttccgaagaacttatctcctttggctgcaatagactgagcggcacggaaatcgtggtcatctttcccaataaatcctgtacgcactcccagttctgtctctccgctgatcccttttttggaaggtgtttttgtgataatattgatgattccgccggtagcattacctccataaattgaacttgctcctgaaagcacttcaattctttcaatattaaaaggatcaatagcatccagctgacggcttatggcacggatactgttcagagaaactccatcaatcattaccagtgcagagcgccctctcatattctgtccgtaattggttcttccttgtggaccgatgtccatagaaggaatcaggattgacaacatttctttgataggaactccgcttttcgcctgctcccggatcttttctttctgtactacccaaaccgttcccggaacttcagagatttttgtaggttttctggaggctacgatcaccacatcttcaatacctttagaggcaatagaatctttaacggtctgggaaagcatcactcccgaaactaaaagacctatgaacgcatactgctttttcattctttctattcaacgttttataatgccgcaaatataattcttatttagaaagaataaaaataacaaaatatgaaattttcccatattttatgatggtaaacatcttcttacagaaaaattaagcttaaggcgaagcccctcttaacactctaaataccttactacaatcctaatgtttcaaaaaagtttaaaatttgacatcttcttaaaagcgtaaaatcccagcccaacgaaggaccaggattttactgtgaaaaacaaggttatcttttatactgcagggccagctgcatcttttatttcttccaataatttttttctttcacgaagtctccttcttgcaataacagacttaccgccaagaactcttacaaatctgaaatactggaaacgttttgcgccaaaatgatgggtagcaacataaatcaaaactccaaatcctaccaaaataatataaccgaatatctttttggtagctatgataatagcattaagctgaatggctttcatattggcggctacattctgaggagtaaccgtcattccgtccatataaacagcaagatctcctattgcggttacctgaaaacggtactgaaaccaagagtacagggttgaaaagattcctacagcaaggaaagttctccagaccaatacaagcccgatggctgccagcatttcatccatttcaagcttatccagcgtataaaaccatacggaaataaacagtgaacacattccgtagccttttaagaacatcggcaggtaccagttgtcataactgaactccagcaccatagaaaaatacatgataatagcatatccaaccatagctgcgaaaccggaaaaaatatacattttcaatggtttttcttttttgaaccagaaaattgccagaactccggccaggataattccgggaatcatcaataaactcagcctggtattggttaattgatcataccccaatacgcctaccgcaaaagtattctgaatagaagcagttcctaaaaacattcccagccaaaaaagcataaataatccgtgctgcacattattctttgtaaaaattttgaatgaaaggtatggccgttttaaggttagctgacagatggaaagaagtgcaaaacttacaaaagcagctatacttgcattcataatattcttcgaattgaaccaatcctgctgtcttccaaatgaataaacataagccgaaaacataaaagttgaaatgaaaagcaaaatacttaaccaatcgatataatgaaggggaacttttaacgcaaaatatttgttatgcataaaaatccagtgtatcaaagctaaaataaaacataaaactgccgtgaacaggtaaaactgctgccagttataaagaagagcgaactctgcagcatagtacgtagccacttgattcatgacaagtacaaatgtgtagaaagcgccataaaatacaccgcggttcccaatcatcaccattaatggcagaaacagctctatggtgaccatcatcttcataaagcctatcattaaagaagtaaatatgaagatcataggttgtaaggtagtcccgttcacataactgagcagtcctaaaagcaccagaagcaaaaccatcttgtctcttaccttgaatctcattttgattctgagaacaacaggcatacaggctcccatccctatggttgtagcgtagtttgcccacataaaatattctgtcatggcaccggtaccgcttaccagagaactgatattcccggtatatactccaccaataggcattaccacggcaagcagcaatacaatcagcagaagctgtacgggtttcggcacccagtcactatataatcctttgttgtacatgatgaatttagaagttagaggttagaaactagaagttagtaactgaaagctttcagcttaacttctgtattttctaatcttttaatctttcaatgattaaatcttttaattactgaccgatattcacattcatattcattccggcgctcagtttatccagatcttcttttttattggaagctgtaaactctattcttacaggtattctctgctgtactttaataaagtttccggtagaattatctgtaggcacacttgaatatcgtgaaccggtagcagcagaaacagctgttactaagccttcgaatttttttccgcctaaagcatctgctgtcatggaaattttctcaccgattttgatattcggcatctggctttccaggaagttggctgttacccatttctgtccattcagaacgattgttgccacctgttgcccaggttggattaattgtccttcagaaatcgttctcctacccattactccatcataaggtgcggtaatcacagtatatgaaagattaattttcgccatatccagagctgatttcgttcttttaatctccgcatcattaattccaagcctgcttttcacttcagtagtagaaagattggcagattgtttttgattgactaaagtctcataagcagctttttgtgcatcatattctgtttttacctgatcatactgctgtctggtaacagcttcagcagccagaaggtttttatatcggtttagattctgttctgcattccataatcttgcttttgcccctgcaatattagactgcatgacgttgatattgttggaaaccgtattgacagaagagcttgttgctgttttttgagccatcgcattctgataagctgcttctgcctgtcccagttgcgtaagaatttcacggtcatccagtatcaccagtgtatctcctttttttacatgctgatgttcaatgaacttaatttctttgatgtaggccgaaacccttgtattgataggattaataaattcctctacctgcgccgcttccgtataagttttgtttccgatatggaaatattcacgaattaaccagaatagtccgaaaccgatcaccagaaaaacgatgatattggaaatgatggctctgattttattggttttatttttcttttttttattctccgcaggagttggtgtagtattttgagtagtttgttccttgttttccattgtgttgattttcagttttaaattaaagtgttcctgtagatttcaaaagattgtaatactgatacagtacattgatttctgcattggcataatcaagctccgactgcagtttctggttctgggcatcaatcatttctgcctgtacagccagctgattcagatatttggcttctgtaatcttgtagttttcttccgccagtcttttagcatcattcaggatatcggcctgctgtatcgcttcctggtatttggtataagctgcattcactcccatatccacattctgctgtaccagagtcattgcatcattcgcctggttcttttgcagctcacctaattttactttttctttcgttttatacagtgcatctatattgtagcttaaagaagctccggtctgccagcctcccgaatacatatccagaacaggatttctagttgtgatcggtctttgcagtgtatatcctccaaatcctgcaacggtaggggcattatccgttttgataatctcgatattcttatctgctaccgcaatatttttttgagccgatttcagcaaagggttactgtcatgggcaaggttcatataataatccatgcctattccggattctttgttctctaagttttctgtgggaacgatttctgtgtctgaaggcagtcccaaagcaatatttaaattgtaattaaggactttcttattgttagaaagggtcagaatcccctgatcaagatttttgatggccagttctccacggattacttcgtttctggtcaccatgccctgctgatagaatttctggatatttttaagacgctcctgagccagttttttattattctgaaacacttcttcctggttccggattttataaacatccagataatttgaaattaccagaaatttaacatcctgtttgtttttttccagatcaagttcggaaagctgctcacgaagtcctgccatttcaatagacttattcaccaagcctcctttgaagatcagctgtgttgcctgaactgcataagaacttccataatgcggcatcggaacgtttgtagaattcgaaaagtccttatcaatggctactgcatcccctaagtagaactgacttgtagaagctgtaattgacggcagtttctgaagttttgcaacattggtgttctgtttggcaatatcaatgttttgtgcggaaactttgagctgctgatgattctgaacagcaagttccgctacctcacctgcggtcatctgtttaatctgttgtgaaaaaaacagcgcaggaaaagctgctatcaagattgatagtgctgtttttattttctttgtcattttaccttgttttacagatgcaaagttaggtcaacaacaaaatcaatcaaatgtttgatttttggaaaaagatgttcaaatgtaagattttaattttcgaactgatgcctgtactgtgtaggacttacttccagatgcttcttaaaaaagtgagaaaatgagtattgatcactgaatccaaggatagatgaaatctccgaaaccggtttattggaagagtttaagagaactttagcttcattaatgacaattaaagcaatgatctgactggcagatttacctgtaatggtctttaccacagaagaaagatgtctggttgtaattgactgcctttcggcatagaactcaacagttctttctgtaagatgatgctcagcaagatcagtaagaaatacaaatacaatttcttcctgtctggacatctgattcatagaactgttgtcttctttggagatgattcctgccatctgatagcagaaaacagagaaaagatgttctaccatctctttcttatagagcatatcggtatcagaatccaggatatacttcaggaaattaacacttttccagactacttccatttcgtcttcaggaaaaggaactcctttattcatctgctgtctgaaataccgataagtaatcaggcggttaaactttaatgataatgctgaaatgaattctcttttataagaaaccatccttgactgaaaatcgcccgtcactcctaccacttcataaatggtttggggatcggttaccataaacatattggcagaaacttccagatcactgaaatgctgacggagttttatggttccggatttaataaagataaaagcaggattatcggggcgaaaaggcttaccaacggctattcgctcgaaaatattacgttccgtaaaaatatcaactccgaacttttctaaggcagacataggacaaatgtaagcaatcttaccagtgattacaaaattttattattttagcatcaatccaattttctgtcagtatgagaaaggttgatctattatttgccgaatacagtaaaagccatagaaaccctacaaacaagttcattcactggatttgtgtacctctgattttctggacgattctgggatttacctccctgattcccgcaccccatttctgtactccttatttcggatgtatcagtattgtaagccttatagtgattcttctgattactttattttatatcaggctttcttttaagatcacggtagtaatgcttgctgtaatgcttgttatggagcatttcatttatcttaccaacataagtattgaaaagcaatcctggatagtttatctgtctgtattcatcattacctggattttccaatggataggtcacaaaattgaagggcaaaaaccttcttttctcaaagaccttcagtttctgctgataggaccgatctggcttttaggatttattttcaaaaaaacaggaatcagatattaatcttccaaagcataaaccgcaaaactggccagccaatggtctcctccgtaattcccctggaaaagcagcggcaaaccgttagccaggaatacatctgctttctccctgaaactttttttcagcggatgattggcaggaagggcatttgaaattcctttcatacaccatgctttggaaaaggacaatcccaccaggtgaaccgtctgataatcgctcaaatcactaacaacaggaattttttcaatattctccagacttcttttttcgtagaaagcattcagccactgtacaaattctttttgagggagtactctccacatcagatctgcaatctcaagacttggagaaaagaaatctgaaccgtccggttccagataagcaggtgttttctgatcttttaagaaaaagtatttcgctttttccaccagctgattttcgaattctttatctttattggctcttgcccaatctatagcaaaagccatagcaaatgcagtattcggatgaactccggttctgttgggataggtttgttttggaagatacgttttccaggatttaaggatctgatctgttaatggtttcagattctgatgccatattttagctttcggatgatcccagttggtgagttcttcatccagttttaatatccatgcccagccgtaagttctctcaaaagtccctgtcagctgatattttgtaaaatagtctgcctctgtctgcagtttatctttctgaaatgattcatccagaattttttcaatctcctgagcattggaaagattgggttttgttttcaaaagtcttgtcagcatccagtgtccgtgaacggagctatgccagtcgaaacatccataaaagctgggatggagatctttaggtgtcaaagaaacttcacctgcattattgataatatgtgccgttttattaggatattcctgattgatgcagtgaagaggtttatcggaaagcttcattgccatttcgtctgtgagtttcggagcctcctgggcatacatcagaaatggagaaaacacaaatgctaaaagactttttttcatgaattaaaaatagaaataatttacagtttcagcaatttttccaatcggttttgaaagcttttattctgaattccggccaatatgcaatatgaaacaatttttaagcacaatttttgatgatatcatcagaaactaagtctatgaaaaacattattcttcttttatccggcattctgcttatcaactgcagtaaatccggcaatgatacatatgaagcgaaagctgatttgatggaagttgtccctgaagagaaaattacagcattatcttctccggcccctgttatttctgagaaaacagtatccgataaaaatgaatccggcacagaaagctatacccacaagaaaaccgatacgatttccaaaaaaattatcaaaaacggagatatgaagattcaggtgggtgatattaaaaaagcgcaaaatcaggtcaatgaaatcatcagaaaaaataatgcctatatccagaaagaagaattccagaatacggatatggatgataatcttacgatgactatccgtgtgcctcataaaaattttgatgcccttatcaattcattttcagatggcgttggatctgttttgtctaaaaatgtttcatctgatgatgtgaccgaggaatataccgatgtagccataaagctggccaacaaaaatatatatcttgaaaaatatcgggatatgcttaaaaaggcttccacaacgaaagatatgctggaaatacaggaaaaaatccgggaactggaagatgaaattgacatcgctgaaggcaggcttcgttttattgatgacagggtgaattatagcaccctgaatttaaatctgtataaagaaaaggtgagaagttcagccacctctaaaattggctttggaagccggtttattgattcactgaccgaaggctggaacagttttgtaagcttcctgctgggaatggtttcactatggcctttctttctgaccattcctgtcatagttttcttttggagaaaatggaagtcaaagaaaaagagtcaaaattaatttattaaaaatccgggcatctaagatgtccggatttttactgcattgtcaataatttattctgtttccagtgtttgattaaaaatcaagaataatgcaataaacaggttaagaattgttaaatctttttgagcaaaaagggtaagaaataattgctattttaccttaaatattatttccccagcacaaatactgcagggattttatgaagttccggcttttgcttctgccagtctttgattgattttgttttaatgaattcatgttccgggtcattaatattggcagcaatacacagtttggaattcggtgacaaaaatttacacaaatcttcaaaaagctgattgttccggtaaggagtttccatgaaaatctgtgaatatcctgttttctggacaagactttccagatgcaggatctgtttctttttttctcctttatcaataggaagatagccatggaaagtgaactcctgcccgttgaatccactggaaatcagcgccagaataatagatgacggccctgaaacaggaatcaccctgatatttttctcatgacaccatttaacgatcaggtttccgggatcagcaatacaaggcaagccggcttctgataacaatccgaagtcctgccctttcagcatcagctcctgagcttctttaatatctgcattctctgtgtatttatctagcagaaataacttcagatcggcctgctttttttcgggagcaaaaaatttaacaacctttctcgctgttttttcattttccacaaagaaataatccgtttgcatgatataatccttcaaaacaggtgaaaagtggttgatagaagtattttctgataagtaagcaggaagtaagaaaagcattgtattattttttagttctttcgtttaatgagggttgtgggaaatattttgtaagatccatagagaagttaacagaggtaattttccaggttccgttgatcttcatcagtgtccagatttcttttccccagttttccattttaccgtcgtaccaaaagctgtaatcaaaattggcagaggcaattgatccgtcttctatgatcttaatattgtcaaatttttcttcagatttatcatctttaaagcttttgataaaagctttataatcatcggcaaagtagtaatccgctttagggtttttctcaagacgtttagcctgtgtcctgtctttgtagatgccggtccagagtacgggttcctgaaacaaagaaagatatttggcttcatcacgggacttaatgcatcccataaagtcatccattactttacggatctctgtttcatctttagtttgggcaaaacagaaattaaagcttactaaaagcagcagcaataattttttcatggttattattttagtatttggtttttaatggcatcacatcccttatccagaagctggaagacattttcgaaatctttcatatctccccaatacggatccggaacctcagcattttcatgatctcccaatacttctaaaaacaatgctactttcttgcgttcttcttcgtttttggttttagaaaccacatcttcaaatacatcaatatccatacagtagattttatcaaatgtttcaaaatctcttcgggtgataggtcttgatttctgttttgagatatcaatattatggttggcagcagttttaacagctcttttatccggatgttctccttcgtgcaatgaaatggttcctgctgagtctaccacaaagttttccggcacttttgttttcatgattccttctgccagaggacttctgcatatatttcccagacaaaccattaatattttcataggtcagtaattataaaaaagacttttaacaacaaaactaaataaaaaatgaagaatacaacgatccttcattttaattattttaaagctcagcgcttatttactgtttgattctttcagtaagatcttttacgtatttcttgatttctttatcaattttcgatacatctttgatggtatcacaagcatacattactgttgagtgatcttttcctcccatttcttcaccgattttagtaaatgtcgaattggtgaattcttttgagaaatacatcgcaagctgtcttggcaatgcgatctctctttttcttgtttttgaaagcagctgctcttttttgattccgaaataatcacaaaccacttcctggatgtaaggaatattgatgacttttttctggttggcagcaattctgttaatggtttctttcagcaattcaagactaaggtctctcttatatactgtagagtaagcgatcactgagttaattactcctatcagttctcttacattggttttggcttcggcagcaaggaagtccagcatatctcccggaagaacaattccatctctgcttagtttatcttcaatgatctgtcttcttgtagaaaggtccggcgatttgatttctgcagaaagtccccatttgaaacgggaaacaattctgtcctggatatccataatgtctgcaggcgccttatctgaagtaaggataatctgctttccgttctgatgcaggtgatcaaaaatatggaagaagctgtcctgcgtagctgattttcctgataagaactggatatcatcaataatcagtacatctaccatctgatagaaattcgcaaattcagtctgtttgtgtgctttggcagcagagataaactgctggataaacttttcagatgataaataaagtacaactttatcagggaactgattttttacttcaagaccaacagcctgtcccaggtgtgtttttccaactccataacctccatataggaataatgggttaaatgctgttgctccaggtctttttgcaatcgatctggctacagttgctgcaaatttattgctttctccttctacataactatcgaatgaatagtcaggtttcaggttagaatctatgtttacttttcttattccaggaaccacaaatgggtttacaatattggcagagaatccctgcggcattgtttcctgtgttttcggagtaggaacgctctgtcctttgatgttcatggtaaccggcttttcttcgccttttggtctgttttccatcacagaataccataatttcactccttttccaatatttttcttcagggcagcagaaagtagggacaggtaattatcctctatatattccttgtaaaaatcgctcggtacgatcaacgtaaggttattggccaccaacgaaagcggctgaaccttatcgaatagcatatcgaaagatttttcaagttttttaaggtcagaattgtcttcagcagcgttcaggttatcgcgcataaactgaaggcatttctgccaaatcatcattaaattgtcatccattttttaagccccgattattctttgtttgtactgtgtttagaaggaagacaaaggtctaattttttcttttcaaaaaaaaatattgcaggtattgattatttaaaaatatatttgtatgtataatttaacacctaaaatgatacacacaacacactcaatacgagtacgttacgcagagacagacccgatgaaatacgtatactacggaaactatgcaacgtacttcgaagtggcgagagttgagctcttcagaagcataggaatctcatacaatgaaattgaaaaccaaggaatttggcttcccgtttcggactacaaaattaagtatatccgaccagctttgtatgatcagaaattagaaattcacacctatgtcaaaaaaattccgggagtgagaattgaatttgaatatgagatttacaatgaagagcatattaaaataacagaagcgtccactactctattctttctggatgcaaaaaccaataaggtaatcaaatgcccggactttctgatggagcttattaagaaaaactggaaagaaaattaactgcggtttttagtttgagagtggcagggtttgaagatttgagagtttaaggcttaaggtcctgaattaatgtaaaaggtaaccagcaacaaagacgattcgcaattcataacaaaagaaccccgtaatacacactctatttatgaattaattcgcacctttgtatctctatttactatcccttatattatacactatgaagattgcttttttgggacctcatgccagttttacacagcttgccgctgctcagctttttcctgatgacgaattgttgccacaagccagcattctggattgtttcaatgccgttgaaaacggagaagccgtaaaggcagtagtgccattggaaaactctattgaaggaaccgtatctatgacgctggattatttatataagaccccgtctattaaaatcgaagcagaagcagtaatgccgattgcccatcatctgatgattcatccggaaaattccattgagaatatcgaaagaatatattcgcacccacaagccctggcacagagctttcattttctggatactcattataaggaaattcctaaacaggacttttcatctaccgcagcagcggctaaatttgtttctgaaaatccggacactcctattgcggcagttgccaatcagtttgccgctaatttgtatggtttgaaaattatcaaccgtaatattcaggattttgaacagaatcatacccggttcatcattatttccaaacagcaaaacaaatatcagaatgatcaactggaaactttgggcgaaaaatccggcatgctgattactcttccggaggatcaccccggcgggcttcatcaggttttatccgtgtttgcgtggagaaaaatgaacctaagcaaaattgaatccagaacgttaaagacaggtttaggaaattatttcttctttatcaatgttgaaggcccctggcaggaagttttacatgggaacgcactgcaggagcttgaatcaatcaatgccaacgttgattttcttggaaattacaaagaatttcttctggaaagctagaaaaaacaccataaataggattaaaaacactgtcattcgggcagtgtttttttgttatttggtactaaaaacacaaaaaattaaaaaaatttcacaataaatcaccacactgaccagttgttccggaccacacaaaaataacccacacattggggagaattatattttgttaaaaccctaataaacaatgcattaattcaaaaataaatataataagtcgtaattaaattatgtggtaattttaactaaaaaataaacatatgtttaaatatattacaactttttaatgttaaaattatagatttcacaatgtcgggtataatttttattgtatatttgcttagcaactaattaaaaaatcttgatcatgaaaactaaactttacagcttactgttagcatgcgcaactttacctttattctctcaagtaggtattaatacggaaaaccccagtgcaactttagacataaacggaaatgcaaagatccgtactactccagcggctcctgcattaaccgggtatcaggtacttggtatcaataatgccaattcagaagtatcttcgattgatcctcttttgatctatgcggctgccaacaccaacacctcagtatatgcggcaaagaaaacagcaggaatcagccttttaagccttggactttttccttcgggattcagagctgtgaacttcctagcagcagaaagaaccataggatctgccagcttattcagtgacacagataatacgtataccattccatccacaggtgtatatgctgtaggcttcacattccgttatggaacaggtctccaggcttctttgttagccaataacccgggaattggtatcgtaagaacccgagctggtgtagccactacgatagacagccgtccgttcagtggggctaacctgattttattaagtcttacgatttcagaaagtactcttagctcagtttattccttccaggcaggagacaaagtttcatttggacttgtcggatcaacagcattagacgtaggcttattaggatccagtgttgcttctttctacatctacaagatatctaattagtaaaaacatattgttagttatatacggttgatccatcacatttctgtgatggattaatttttggttatatttgataaaaactatgaaatgaatgaatatctccttattatattaatcattatcgttgttcttattttcaataatctgaataccagaatcagaaaactggaaaaggagatctcagatcttaattataaaatcggcaataaacctgccggacctgaagttacgccagagaaaactccatctgaagaaacgatcatttcacagacaatatcacctcaacaggtttatcgtgaggacacaaaacatactgaagaacctacaactcctcccggaaaagactggctggctcccatttttgattttctgaaacagaatgcacttaccataattggtattttcaccctagttctgggaattggttattttgtaaaatatgcaattgacaaaaactggatcggtgaagctgcaagagctggcataggtttttgtaccggagcaggcatcatcatgaccggacatttcctccgaaaaaattacaaagccttttcctctattattacaggaggcggaattgctgttttatatttcactgccacaattgccttcagggaatatcatctttttagtcaaaatacaacttttgccataactgtcctgattacagttgcctctatcattttatcatattattataaaagcgaggtgctgattattttttctcttataggaggttttgcagctcccttaatgatcagtacgggacaaagcaattacctgttcctctttatttatctcacgctattaaacaccggaatgctggtagcctccttccttcagcattggaaaagcgtgggctggacagcttatattttcacaaccggttatcttttctcctggaccaatgaaagtcccgagatcttaagcattactttttatctgatcagttatgtggtattctatattttcgcactgcatgattacttcagaaaaaaaatcctttcaacctctgatattgccattcttgcgcttgctaatttttcaagtgttctgggactgatctatatttttaagacccttgggtatgaacctcctattattttcccgcttatttttgctgcagccaattctatcctgctgtttagagaatatgcacataagaatttcgggattgcttattccgtctttgcaggactggtgacaagccttataacaattgctgttgccattcagtttaaaacccacctcattaccagtatctgggcaatagaaagcaccctgcttcttttcatctggaaaaaaaccggccataagattttcaaagtcttcttttacatcctgtttccattggtaatgattgcccagctgatcacatggactgaatattttggaacaaaagattttaccatcatattcaatcctccgtttattaccagctcatttactatcgtttctataatgatcaatttgtatttattaaggaatgggacaaaagagccggagggcaaagacaataacttttttgaagatcttatcactgtaatcagctatggtgctatttatattacgttcctgcttgagattacctatcatatttcagaaatgcattggtcagcagtttctactgcagggctgttattcagtatcttctatatttttgtattactgcttttaagaaaatctctggatatcagaaatgacattcagaatattctgatctacctgctccttttattaacagttctcactatttctgtatccactccggcagtagttacagctgttttatcaaaaaaactgtatagcggtttctatctgctgcatctgctgctatggataccttttatatatgtatacagcaaaattattccttactcggagtttcacaaacgtctgatttcctactggatactttcctttgctctcattgtattggtaagctgcgagctgcatcattcgtatgttttgctggtttcaaatgacattcctcaatcttatgaagcgaataaacattttaatattctttatcttccaatcatatggacgatccttgccagtatttttatttatacaggtttaaaaaggaatatccaggagtataacaaaattggttttgcgctggtgggtctgatggtattgaaactgtacggctacgatgtctggcaaatggataatatttcaagaatcagtgcctttattgctcttggaatcattttattgttaagctcattcacttttcaacgcctgaaaaacatcatcagaaatatggtagacaagaaggataaaaatgaagaaaatgaggaggccgccggatgacaatcaggataaaagtttttatctctaaataaaatgtaaaacaatataagatttcattcagattttataaaaaataactatatttatcacgtttttaacagttacatattctgattatgaaaaaaatactctattcttttttactattttcctctgtgactttatttgcacagcaaaaaaatcctgctgtaaagtttgcagtggctgacaatgctatcggaacagtagaattattcaatacaactacaataaagaacctgatgcaggtttcaaaagtttacaataacccggcaagttttccacagagtttacaaaaatacagttctgtttttaccaaagggatcactgaatataagttcaaaaatgggcagaatccatttgataaaatggcattatctgaaatcaatgtacaatacaacatcccggcggataacccggtatttattgaaggatatgaatttactgacaccagcgcgttaatctacccgcagatcaggaaaaaaatggaagtaaaagattataatggtaaaaaaacattgttcatctatacaactgaataattgaatactataaaaaaaggatgctctaaaacagcatcctttttattttaatatttattgttccacttttttcttagctcatcgtagattttcttttctgtagaattattcccgggctcatataattttatatttctgatttcttcaggaagaaagtcctgttctacaaaatttccctcataagaatgggcatatttatagtcttttccatagttaagatctttcatcagttttgtaggagcatttctcagatgaagcggcacaggcagattacctgtctgtttcaccaaagccagcgcttcgttaatcgccatgtaagcagaattacttttaggggaaaccgccagatatatagcagtttcactcagtataatcctcgcttccgggtttccgatcacattaattgcctgaaaacagttgttggcaactaccaacgcattcggattagccaaccctacatcttcagctgccagaattagcattcttcgggcaataaacttaatatcttctcccccggcaatcattcttgccagccagtaaaccgcaccgttaggatctcctccacgcatagatttgataaatgctgaaataatatcataatgctgctcaccgtttttatcatacaacgccatggtctcctgaagaacttcaagaacatccgaatttagaatttcttttgtatcagagtttttatattgattcagaaccaactccacggaattgatcagctttctggcatctcctcctgaatattgaataaatgcctctttttccaggattttaaaatcagttccctcatctttattgtacctttccgaagcgatatcgataagctcttccagcttttcatagctcaaagcttttaaaatgtaaacctgacttcttgaaagcagtgctgaaaccacttcaaagctcggattttctgtagttgccccaatcagtacaatccaacctttttctacggcatgcaataatgagtcctgctgagatttattaaacctgtgaatttcatcaataaataagattggcgactttccggagaacagattctgttttttggcatcttcaatcacatcacgaacatcttttactccggaagaaactgcagaaagcttatagaatttccttcccgactgctccgaaataatttcagccagcgtggttttgccggttcccggaggcccccagaatatcagcgagttcagggtattgttttcaatcattttcctgatggttcctttatcgccggtaaggtgctcctgccccaatacatcgttcagggttttgggtcttaatttttcagctaatgggatattttgattcaaagtaattctatttttttaagatcaatgtcccggatttccgatctccgaaacttataacaaatttaaactaattttcatttttttaccctatttttgcattgttttgaaacttacattcaataaaatcattacatttccactggtaattttgatcaaattttaccaatggttcatctcgcctttacttcccaaaaactgccgctacgaacccacctgttctcactatatggtagaatcacttcaggtacacggcatctttaagggcttctggctgggatttaaaaggattttaaggtgccatccctggggaggaagcggttatgaccctgttcccccaaaacataaatgtcaataatcaaactattaaatcaatagaaaaatgaatactttttttttcagaatttactttgttctgtttgcgttgatcactcaatgcctctttgcacaggaataccctggaggtttatctgacggaactttagatatcaatggaaacaatattcctgtaaaaatctattctaccacggagatgggggaccttacggcttttcctgacagggaatcggataaaaaccagtcttttgttgtcatcttaaatgaatcaaattttgagcctgaatattacaactatggcgcttcaactttagccaaatataaagattcaaagtatcagtttttcgataaaaactttaagcttattgatacttccgttaacagggataatatttcaaaattcaaatatgcagtaaaatcagtgaagcctattactgattctgataaagtagagcttaaaactccgtttaaaatatgggatccttcaaaaggaattcatatcggatcctttacccttcacttttatagtctgatgtttgtttttgcatttggattcggatatgttttaatgacaagaatctttaaaatcgacaacgttaaccaaaaatacctggagccccttttcacatggacattgatcgggactattcttggagcaagattaggacacgttatcttttatcagccggaattatttaaagaagatttctggagcgtatttttgccaatcagtaccaaaaacggtttaaaatttacaggattttccggactggcgagtcatggcgctacaatcgctttgattttcacaacattatattattcatttaaagtcatcagaaaaaatcctttctgggtatatgacagattaggtattgtagtggctttgggaggtgcatttgtaagaatggggaacttttttaattctgaaatcgttggtaagccagctgatcccaactctccgttcgctttacttttcccgcaacaaagcagcgaatatggtcttaccgttccgcgttatccaagtcagttatttgaagcggtagggtatgttcttcttttcattttattatggattctttacagaaaaaccgataaaaaatatcaacaaggctggttatttggtttatttttcatcattctttgggcaatcagattctttgtggaattccttaaagaaccacagggagatgaattcatccagattggcggtctgaatacaggccaggttctatctatcccttttatgattgcaggagttgtaattatgattgtttccaagaagtttaaaatcacaccggaagaaaacgcaaaaccggaataggttcaacagactaaaaggtaaaacagctgaaaagcaaaaaaggcaaatctgtaaaatacagatttgccttttttaatatcttaaaattatttcgctgctactttttcttccggtgttttataaattccttgctgttttcctgttcagctcttcaaaaacacttccaaatgcatcaataacatcagtgggaagtacagattcttttgaatgcttttctgaagctatctccgcagccctgccatgcagccaaaccccaaggatacatgtatgctcttcagaatatttctgtgcataaagtgaagtcagaattccggtaagaatatctccgcttcctcctttggcgagccctgcatttccggtaatattgtaaaatacatttgcctgcggggtaataatctgggtatgatgatcttttaacacaatataaatatccagctcttttgccttttgtctggcaagcttaagccttttgaaggaatctgcagtacttccgaaaagcctttcaaactctttcggatgaggtgtaatgattgatttctttggaattaatttcagattttctggattttttgaaatgatatttaaagcatctgcatccaggattaatgaccgtttacagcttttcaaaaagctcagaaagctcttttctgtttcctgatgagttcctaatccgggacctataccacagataaaatcatcttcaatttcaaaattaaggataaacttttctcctcctcctatgaacattgcctcgggacatgaagtctgtaaaatctcatatccgcattcaggcgccagggcaaatgttaatcccgcacctgttttcaaggctgattttacagccagcaccgcagctcctatttttccgtaacttcctgctacaatggctgccttaccatagctgcctttgtgagaaaaatcctgtctcggaacaaatatagattctatcagcagatcatcaattacagaatatacagcatcagtggtgtctgcgtaagttttgcttaaatcaatatccagcacttctatttttccggtatattttccggtttcaggatgaagaaaagtccgtttccagcattgaaaagtcagcgtataatcagctttcataatgacagcattattgtcaaacatttcatctggtgacagcccggaaggaatatcgatggatattttaatattctttttggtattcagctgctcaacaagcgatttgtattctccttccaacggtcttgataatcctgtcccgaaaaaggcatctacaataatcgttttatcatcaaaggtatagtgttcatcaggatcaaattttctgactgaaattccagacaaatcacgaagccttttaagattaacagatgcatcttctgaaaacttctttttggaatcgcttataaatacatctatgtcaaaacccttaagataaagtattcttgcaacagccaacccatcacctccgttatttccgttaccgcaaaatacagccagctttttatggtttttacaatgttcagaaatccagtgagcaacagccattgaagctctttccatcagctggatggaagaaatgggttcatgggaaatggtaaactgatcccagctgcgtatctgttctgcggtaaaaattttcatagacaaatcaaacttttaagcaaattacaaaagatttttcattatgatattacggttattaataaaaatacggagtcaccattaatgaattaaattatctgtataaagttaaaatatccattaaaatgaataacatgaaatcattgtaaattcaatgttttgggaataaaaaactacataatttagtgttttttacattttttaattatatttttgtgtatatactaattaaaaaaatataaattatgggatttgtaaaagaatttaaagagtttgcctttaagggcaatgttctcgatcttgctgtcggtgtgatcattggggcagcatttggtaaaattgtttcgtctttagtggaagatgtaatcactcctctgatattaaacccggcattgaaagccgccggtgctgaaaacattgcaaagctgtcatggaatggtgttgcttacggaaatttcctttcagcagtaatcagtttcctttgtattgcgatggttcttttctggatcattaaatttgccaataaggtaaacaaaaaagaggcacctgctcctgccggacctacagaagatcagaaattactgatggaaatcagagatttgctgaaaagcaaaaatatatagtctgttaaaaacttttttaaaataaaaaagcacctcgttttgtagactgaggtgcttttatttatagtctgatttaacttattgaatctgtaagatacttgaaatctgctccgcaagggaaagtcctattctatcctgtgcctcaagagtggaagctcctgtatgaggagtaagagaaatcttagggtgagtaaggatttctttggaaggtgttggttcattaatgaaaacatctaacccggcaaatcttactttaccggaatccaaagcctgaatcaaagccgcttcatcgataactccacctcttgaacagtttacaatagccactccgtctttcatgatttcaaattcattctgaccaatcatataaccatccttctgtgcaggaacgtgtaaagtaatgaagtctgaatgttttaaaacatcctgtaacggctctgtctcgatatcaacattgatgaactgattgttgtaaaatttcactttgatgcttgctcttcctacattattatccgcagcaaccactctcatcccaagacctaaggcgattcttgctacttcctggccgattcttcccatcccaacaataccgatggtttttcctctcaattcgataccgggcgcatatgcttttttaagagctgcaaattcagtatctcctactacaggcatttttctgttggaatcctgaagaaatctcgcaccggaaaataaatgggcaaaaacaagctcagccacagattctgaagaagcagaaggcgtattgatcacatgaattcctttttctctggcataatctacatcaatattatccataccaacacctcctcttccgataatgtcgatggacgggcatccgtcaataatatcttttcttacctgtgtagcacttctcaccaataatgtacggattttgtgctcattaatataatctactaaaaactcctgcggaacttttgtagtgatcacttcaaagcctttttctgtcaatgcatctattccagattgatcaaggccgtcgtttgctaaaactttcataaaatatcaagtatattaaaaaatgaaagatttaaaaattcagggaaatgtttccatgtaatttttaaatctttgaattatatttttattcgccgtcttctttgaatacttcaatggtcacttgcttttctaccagatccgtaaatcttcctttataccttgtagctcttaccaggtggttatctatccagtgataatttccccctcttggttttccgcaaagcacgctgtggtatttgaagccatgcttatccagccagtcgatagtgatttgtttcagattttcggttcttgaagtaaaaaagcatatctgatgcccttcatcataccatctgttgatcgtttccagtgcatcagggtatggttcgcaggtaaccattctttccggttcttcattgggaacgtcatcagtaatggttccgtcgatatctattaagtaattttttattccatcctttagaataggactaatgtgttcaatgtattctaattccattactaaatattaagtaacaaagttagcgtttttagaactatcaggcacattaatcttagtttaagttaaaattttactataaaaaataatattcagcgaataatatcaataatttattcatcatttcactcgaaatagttaaaatttttcgttttgaatttcttttcaataaagtgaatccggatgcagacaaatcaaatcggagaactgatcattttactccgttactttttgtctttcccttcatcttgttatcattattataaaaagcatgatgtttaactaaaaatttccaaaatacatttattacccttacatttgtaggaatggaagaatttgtcgttttagtaaatcctgaagatcgggttttagggctgatggaaaagcaacaggctcacatcaatggtctgctgcaccgtgctttttctgtatttcttttcaacagcaaaggagaaatgcttctgcagaaaagggcttcaggaaagtatcattctcctaaccaatggaccaatgccgtatgctcacaccccagagatggggaaacctatcaggaaggagcagcacgcagactgaaggaagagctgggaatagagacagaactttcagaaaaattcaattttatttataaagcagatgtaggcggcggcctttgggagcacgagctggatcatgtatttgtgggaaatcatgaagcgggtttcaatttaaataatgaggaagtggaagccgtaagattcatttctatggaagatctggacaaagaaatttccgcacatcctgaaaactttacagcatggtttaaaatcatcctggaagaatataaacaccatttttaatgatgaaaaagatattgtttttttctgctcttttgacgggaagcctgtttttctcacaaaaagcaaaagtctacgaaaattccaattattctattaatgttcctgaaggctggagatctactaacgacagtgaaattgttaatattttccctaccagccagatcggtgcaattaccatttcggaatatcatgatcttccccttccaaaagaggaagtgaaaaaatttatgctggcactttatcaatcacaagaccaggaaagtaaagtaaaagaaaaaaagagccagaaaggatatacggaatacctgtatgaacattttgatgaaaaagaaaagctgttctgggtaaccaaagctttccagaaagacaaaaacttatatttggtttccatcaattgtggccagaaattctggaacggaaactacatgaccctattcaatgagacttttaacagttttaaaataaagaaataaaaattaaatatgaagaaaacagccttgtacgacaaacatgtttctttgggagctaagatcgtacctttcgcaggttttgaaatgcctgttcaatattcaggggttacagaagaacattttgctgtaagagaaaaagcaggattatttgatgtttcccacatgggacagtttttcatcgaagggccgggttcaaaagaccttttacaatttgtaaccactaataatgtagatacgcttgaaaacggaaaagctcagtactcttgtcttccgaacgaaaacggaggaattgtggacgaccttatcgtttacaaaatggaagatgacaaatatttcgtggtggtaaacgcatccaacattgataaggactggaatcatatttcaaaatataatactttcggggctaaaatgacgaatgcttctgatgaaatgtctttattggcagttcaggggcctaaagctactgagattcttcaaaaacttaccgatgtaaacctttcggaaatcccttactatcattttactgtaggaagtgtggctggagaaaatgatgtgatcatttcgaacacaggatatactggaagcggaggttttgagatttatttcaaaaatgaaagcgctgaaaaactttgggatgctgtaatggaagcaggtcaggaagaaggaattattccttgcggactggctgccagagatactttaagattagaaaaaggattctgcctttacggaaatgatattgatgatacaacctctccgattgaagctggtttgggatggatcaccaagtttgataaagacttcgtttccaaagatgtttttgcaaaacagaaagaagaaggagttaccagaaaattagttggtttcgaactgacagacaaaggtgttccaagacatgattatcctgtagtagatgctgaaggaaacgtgatcggaaaagtaacttcgggaacacaatctccaatgaaaaaggtaggtttaggtcttgcttatgttgacaaacctcatttcaaattaggatctgagatctttattcaggtaagaaacaagaacatccctgcaaaagtggtgaaggctccttttgtataatctgttcaggatataaaaaaagaggctgtgatttcttcacagcctcttttttttggtttaatagcagatgcagcaggtttttctgtcagaggtacagacatctcctactcccggtgtattggaaattacacctccggcaggtccgcataaaatactgcagacaggtaaagaagcaatacctccgttaacttctttcagttctgatctgtttagtttttttgtttttgaaaagtttgttttcatattgtacatttttggtaatcacaaatatagccattcaaaaacaactaacaatcaaatacttacaaaaaaaacacccaatctgatagatataaaaatatccggcacaataataaaaatcattaagccggacaggttctctttaaagctatttattggtttacaccaaagaacttctgtagttcttcaacatttttcttatcatttcctacaaaaatttctttatctgtcataaaaacaggtctttttaaaaaggtataatgatccagaagcaattctttaaaatctttttctgtcaaagactttacatccagccctctcagtttgatctgagtagattttttactgaataacgcttcgtacgattttgttttcttatgcatttctgccaattcctctttcgtgacgggctcttttttaatttcgcgaagttcccagtcagtaagatcaaattgagataaaatttttctgcaggtatcacatgtattgagataaaatactttcttcattacgttttctaaatctgttgttggttaaaattccctttcattgaaagtttcgtctttcaaaagtaggatttaatccaaaaatttggaaattattaaataactttattcaaattttataaagatgcagaacaagcctattacttttcagtttatttcggagccttcagatgttaattacggaggaaatgtacatggaggaagtgtgatgaaatggattgaccaggccggttatgcatgtgctaccacatggagtggtaattattccgttacagtatatgttggcggaatccgtttttatgatcctatcaaaatcggggaagtcgtaaaagttgatgcccaggtgatttacacagggacttcaagcatgcatatcgccattaatgttttttcaagaaacctgaaacagcctaattttgagaaaaaaacccattgtatcatcgtttttgttgctgtggatgaaaatggtaaaaaactccctgtacctaagtggactccggaaacagaggaagaaaagcagcttgaaatgtatgccaaacgactgatggaacttagaacgcagattgaagatgaaatgaaaccttttttgtaaaagaataagattcataatctccatgctgaattcacgaacctgctttttcatattatattgtataagaaattaagattaactaatttagtatcaaccattttaaagtataatatgaaaaatattcttacaatcacagcatttctgttgatggtttttcctcaggcacaaacccataggttcatttatgaacttcagtataaaatggattctaccgaggtcggatatgaaaaagtgaatatgatcctggatatcaccccgaaagaggtaaagttctatggaaaagatgtcgccatcagagattcactgaataaaaaattcggcatgaacttcagctatactgatatgaccggacaggtagttaaaagaaagatcaattcttttgataatgaaaattttatcaacattaaaaatggatattatacatttaaaactacagataagatcaattggacgatcgctgatgagattaaaaaggtagaaaattatactttacaaaaagcaactacaaaatttggagggagaagctggacggcctggttctgtaaagatattccatttaatgaagggccatttaaactgcgtgggttacccggtctgatctttgaactatcagatgctaagaaaaacttcctttatactctcgttaaaagcagagaacttccggaggtctccaatacttcggatttcctggaatccagctttggtaataaagcaattcctattaatgaaaaacaaaagcataagctgatgatggagttttataatgaccctttcgcctttgaaagaaataatatcagcaaatccaataatgaccttagaattaacatcaacggaaaggaaattcataatgtagatgaactgaatactcaaaccaaaagtatgcaggaggttatcaggaagtataataatccgattgaaatcgataaggcgatgcattatccgatatattaaaaccttggtttatttttaagtttgggctaaagccggtggaaattttttaaatttatttaggcgggctaaagcccacctctagtaatgttgacatataattatttaacgacagtatcttttagaattgttactaattacgttatagagattcctccggaatgacaaaagaattaagtactaccaaagacatgatacaagcagtcattgtcatttcgtaggaatctaattattatagcctataaaacctgatgaaaaattaaaaacaggagaaattccttgatatctgacatctgaatgtatagctgatgtttaatgaaaagatcttttatcttttatcttttatcttttatcttttatcttttatcttttatcttttatcttttattattacatttgcaatatcaaaaaggaaatggtgttcttccttacccaaccgctttacaaaagctgatgacgcctgattaaaagattattaacaaataactaatcaggattattatgtcaaaaaatcaacggacacttggtaaaaaagcagtttttcacactcattttttcttcagaaaattcccggcactgccttatattttaaaatggctgttcatcagtatgattataggagcattagtaggaaccgcttctgcaggatttcttcagtcattggaatggactaccaatttcagagagaatcatctctggctgatagcttttcttcctgttgccggatttttgataggattgctttactattacttcgggaaagatgttgaagcaggaaacaacctgttgatcgataccatccatgagcccaaaggcatcattccgtttaaaatggctccctttgtttatctgggaacgattgcgactcattttttcggaggttctgcaggtcgtgaaggaacagcgcttcaaatggcaggtgctattgcagatcagcttacaaaaccttttaagctcgaccgaaatgatagaaaagtactgattatttcagcgattgccgccggatttggctctgttttcggaactcctttggctggtgcagttttcggtcttgaagtttttctaataggaagaatccgttataatgctattttccctgcatttgcttcggccgttcttgctgacctggtgaccagtctctggaaagtaaaacatacccattatcatattgatttcatcccaaaactggaatttttacccattctttacagtattctggcaggtattacttttggaatctgtgccgctgctttcagtaaaatcattcattggatgggatcttttttcaaatcgaaaatcaaatatcctccgcttcgacctgttgccggaggaatcataatagcacttgccgtttttgctatgggtactacccgttatattggactgggaattcctgtgattgtagaatcttttgaaaagcagcttccactatatgattttgccttaaaaatgatctttaccatggttacactttcggccggatttaaaggtggtgaagttaccccgctgttttttatcggagctactctaggcagtgctttatctctttttattcctttacctttcgggctattggccgggatgggatttgttgctgtatttgccggagccaccaatactcctttggcctgtatgctgatgggaattgagctgttcggagctgaatgtggcgtgtatatagctattgcttgtgttgtatcttatcttctttcaggacataacagcatttatgcaaagcagaaaataggagaagcaaaaaacagaagatacgaaagtcagcaggacaggtctgtttcggattttttataaggggtttcgagatgcggggtgcgggttacgagttacgggatgctggtttttattagttctcagttcttcacttataacatcttgaacccaaaatccctcaaacttaaaaactcaaacctgaaatcccgaatcccgaatctctcaaatactcagactccaaaaccctcaaactcgcaacacgcatctcatcaccctcaaactctcccactcccttcatcatttccaactataattcgtaattttaccgcatgttcgattacagattaaaagttttccatacggtagcttcccgcttaagtttcactaaggcttcagaagagcttcatatttcacagcctgctgtcaccaaacacattaaagaaattgaaacccaggtaggcgcgaagttatttgaccgtaaaggaacttctatacagctgacccaaagcggtaagattttgtatgaacatgctgaaaagatcagaaatatctaccgtgacatggagtttgaaatcagccagatcaatcaacaacataagggaaaactgattatcggagcaagcacaacagttgcgcagtatattttgcctgaaattttagccaaatttaatacttactataaagatattaagattgagcttcttacgggcaatacggaagctatttcatcacttttaaaggaagaaaaaattgacctcggtattatcgaaggtgagtcgcagtcttcttattttgaatacaagactttcaaaccggatgaaattgttttggcagcaaaatccgatcatcctcttgctcataaaactttacacctaaaggacctttatcagctggatctgattttcagagaacagggttccggtacgctggagttcatacaaaacagactcaaagaaaaaggaatcaatatcaatgaattaaataccgttatgcagttgggaagcagcgaaagtattaaaaattaccttcttcattcggaatgtatggcctttctttccatcagcaccatattgagtgaacttaaaaataatatccttaccgtcattgatattaaaaacttcagtattgaaagagattttcattttatccttcctaaaggtgagcagtctgaactgattaagcttttcctgagatttgctgagcaataagcaacaagtaaagatataacttatagttatcctatataacaaaatacgatttattttgttatactattttccggaattttggtgcagattttaaaagttcgcattatgaaagatttcattcagaatgaaatgacccggaaaatattctttatagttttggccgtattatgccttacaccgctcatatcttctccaattgcccttgctttgggatttgccctggctgtttttatgggaaacccttttgaaaaacatcttcatcaatatattcatctgctgctgcagatttcaattgtaggactgggattcgggttaaagctggatgaagctcttaatgcgggaaagacaggcttgatgctgactattgtaagtattgttactgtaatggttttgggatattttctgggaaaaatatttaaactggaaagacccttgtcttatctcttgtctgcaggaacagctatctgtggcggaagtgccatcgcggcagtatctcccattattaaaccaagcacgaaacagatttcccttgcgctggcgattgtttttaccttaaattcaattgcgttgtttgtatatcctgcgatagggcatctgctgaatctttcacaggagcagttcgggctttggtgtgcggtgggaattcatgatacaagttctgttgtaggtgctgcaagcaaatatggcgatgaagccctcaaaatagcaacgacagtgaagcttgcccgtgcattgtggattatcccggtttcactgattactatgtttatttttaaaagtaagggcactaaaataaagattccatggttcatcggctactttattattgctattcttttgaatacatatttcccggttcttgatcgtttcagtagttctatcacagttctggcaaaatccggactgaatctgaccctgtttttcatcggttctaccctttcccttcaaaccctgaaatctataggattaaagccattgcttaccgcagtactcctctggattacgataagtgccggcagtcttctttacattatccgttaaaaagagcagcacccttttgaaaacaaaagggtgctgcatattaaatgtggaaatgtttatttcatattgaaataatttctttagatagcagcttcaccacaagtataaacctgcgggcaagcaatatactgtacgcaataccacggtcctgttactgatcctgagcagctgcatccgcaaagagataaatcaggatttccgcttattcctccagtaatgtttttcagatcctgctttcttaattttttagcatttttcataatgttcatgagatttagtttgattaaacaaatatagttttagttacttcccaaagttaaacaaatattaattacacgcaacaaaatttagtataaaagttaataatttattgattataacatgattattatattcaaaacaaggaataacttttttcttttttttaaacagtttcatttattctgtaaactcaagatctttgtcgtgggtttctgaaatcgtaagtgaggaataaaatgccagcccgaatactaccacccctacaatggcagcgctttccaccacaggaaaatgagctttaagtgaatcaaaagccagaatcataacaggaacaaggcctctcaccatattcggaacagttgtcgttgctgtatttctgatattggttccaaactgttctgcggctaatgtcacaaacatagcccaatatcctgtaccgaatcccaaccagacacaaaacagataatattttgtttccgtattggtattaccgaacagcatgatggcgaccccaatcagggtaaagatcaacatgtaaaagatggccattttgcgtgattttaaagcatgggaaataaaaccgctcagcagatcaccgacagaaatacctatataagcccacataattgcttttccggggttgatgtcctttatacctaattcaggcgcaaactgattggctaaaacagccagaatccctatgcaataccacgtaggtaatcctactgcaatacattttaaataccttatcaatcggtctttattggtaaagaaagagagaaagtttccttttgagacatttttatgctcaatattcttgtaaatcccggattccgatacgctgattctcagtatcaataacatgattcccataatcccaccgattatgtaagaaatgttccagccaccagccagctctacagtaagctgggcaacaacagcgcccattaatccaaatccggcaacaactgaggttcctattgcccttaaattcttcggcaggctttcagaaaccagcgtaattcctgctccaagctctccggccaggccaataccagcaatgaaccttaaaccggcatattgatatactaactgctcttttggaaaataaggcagaaagccacaggcaatattagccaatgaatacaccagaatagacccgaagagtacggaaagtcttccttttttatctccgaagatcccccagaaaacacctccgagaagaagccccaccatctgacagttcagaataaaggttccgtctgcatcgggattcagtcccaatgcctttaagctgggtattctgacaattccaaacaaaaggagatcatagatgtctacaaagtagccgagggctgatataataacgggaatagagaaaatgtacttcagtttcgaagacagggacagttcttgcattttggatttttaaattttgttaaaaataaaaattaattgaacaaagtatctttttttttacatatatctattaatctttgatttatcctaaatagtttatttcaataattaatgataaaagattaaaaatgtaaatacataaataatatttttagtttttttgaaagtcaatattaaagaatgatgaacgcttacaaattattttctgaaatcattttaaaacgcttttatttctgaaaaaaaatatataaaattgcattagaaatagatatcgacatatcatttaaaatataaagcattagcttttcttgtctcggtaaactggtaatttaaaagtgtacaagaatatgcgatgctcacgcttcggcgtgggctattgtttatctgtacacaggtataccagtacctccgagacagtaggcatagttccacgctttttttgtttctgaaactgattagctagggataaaaattaatttaaccatttggcacttgtagtacgtaatacaaatgaaaaatggataaatagacttgcaagcaagacaccaataggaatctaatgtgcttataaactttgattcacatttaacaattaaaaactttaaacaagatgaaaaaattccttttttcgggactattaatgattagctccctatcttttgcagcagtatggacagtaacaactacttgcggagttgttggaaaaatcgaaattgccgataatgctacgacctcccaagttgcccaagcagtaagccagtataattataatcaatgtggtgttagacctgctaagattaatctcagccttgaaccatagccttttttattagggttcgttaaattggcgaaccctagtaattaaaatctaaaaatatgaatctacaaaaaatactattctttttctttatttgtatgatcaatttcttatcctctcaggatttaaagtctaattatgtatgtacatataaattggattatataataaatgggaaaaaagaaaatgagcaattcattatgcatattgatgctaaaaataaaagatcattttttcaaagttcaataaattatgcaaaggatacaatagatataaaaaatccaatgcaattagctaattatgaaagtgattttaatgaaaaagtgctatttgataataattcatttaaggtttttgaaaccgttatagatgccaagctatcatattctgaaaatcaaaaactaagctggataatattagataaaattaagaaagaagaaagtgtaacaatacaattagcaaaaactaacgcttatggaaggacttggtatgcttggtttagtaaagatataccaattgactttggtccttacaaatttaatggtttaccaggttttatcgtttctctatatgacgaaaaaaagaactttatatatactcttcaaaaattcaaaaagaaaaataaaacaataaaacttccaaatcctaaaaattataagaatattcctaaaaaagcttacaatcagtctagatttaaaatacagacagcagatagcggagttattatttttaacaatgcaaaggaaagggaaaattggatgaaaaagcttgaagaaagatatatagtttcgcccttgttagatattgagtttccaattaaataatattatatggtgtttatagagattaagcagaaacttactatctattctagtactcttcgtattcggtttagtacatgggattataagtctttcataacaaacaaaccctatcaaaaaatcttgatagggttttattaaatatttttctgattattatctggcaatattcacagctcttgtttctctgatcactgttacttttacctgtcccggataagtcagctcattctggattttctcagagatatcgtaagaaagctgggaagctacttcatcgtttacttttccgctttctaccattactcttagttctctacccgcctggatggcataggcactggatactccatcgaagcttaatgctgcagattcaaggtctttcaatctctggatataagattccaatacctgtcttcttgctcccggtcttgctcctgagatcgcatcggcaacctgaatgattggtgataataatgatttcatttcaatttcgtcgtggtgcgctccgattgcgttaacaacctccggattttcaccgtatttctcagcccactgcattcctaataatgcgtgtggtaattctgattcctgctcaggaactttaccgatatcatgtaaaagacctgctctttttgctaattttacgtttaatcctaactcagcagccattgttgcagcgatattggcaacttctcttgagtgctgcaataagttctgcccgtaagaagaacggtatttcattctaccaacgattttgatcagttcagggtgtaatccgtggattcctaaatcaatgatggttctcttacctacttcaatgatttcctcctcgatctgttttcttgttttttcaacaacttcttcaattcttgccgggtgaattctaccgtcagttaccaatctgtgaagggatagtcttgcaatttctcttcttaccggatcaaaacaagaaagaagaatggcttccggtgtatcgtcaacaatgatctctactcctgttacggcttccaaagcacggatatttctaccttctctaccaataattctacctttcacttcatcagactcaatattgaaaactgatactgaattttcgatagcctgctctgttccgattctctggatcgtttggataacgatttttcttgcttcgtttttagcattcatctgagcttcctccatgatgctctgaacgtgtgcctgcgctcttgtttttgcttcagctctcatggtttctaccaattctgctttggcttcttcagcggtatagttggaaattttctcaagtatttctactttcttagctgttgcaacatccagctcctgctgttttctttccagaatttcgttcttcttagcgtagtcagcaatctgcttatccagatctttttcaagtttcccggtcttgctaagctcgtcattcagcttatgttctttatccttgattcttttctcaatctcctgcattttcttttcgcgggcctgaatgtcagcatcatgctgtgatttcagttccaggaatttttcttttgcctggagatttttttctttctttatggattcagcctgtacattagctttttctataaggttttcggcattcttcttggcatcatctatgatgaattttgctttagtattcagagaacttctggaaaaaaacattcccactacagccccgattaccaaacaaacaacaccgactataacttctatcataatatatattgagttttaattgtattcatatctaaataaaaaaagcctacaataatccagagattgagagtaaactcctaatcaacacgatttgaactgatttccactgtctgtaatccggaagtccggcgcgccattcaatggacatttgttcggtaattgtttagcgttgagtttacctttaatgtgttagaattattgtaggcagtaatttttcaggaaaaaaaatctatttcccgatttcattcaacgattgattaatctgtgctaatctttcgttggtagaattaatatttttctcgtagttaagagaaaccacttctgcattggttcccagtttaagggcacacatagccaaagcatcctgtttatctcttacatcgaaattctgttcaaaatctttaatcatattctcgatctgcttccctactttacgcaaagtttcttcctctgctgccggtacgttcagcggatacactcttcctgcaatgttgacggttattctccttatctccattataatccactgttttgaagctgagcaatacagaaatcaatttcttttaccaatctgttgatatggtttttcattaatctattgtgttcaggatttcctgatattgctgaataaagttttatatttttttgttcttctgctaatacctgattttttcttctttcttcatcatacttcttcttcaactcttcatgctcaatacttaattcttttaaattttccgtaagatttttatagttcttttgcagagtcgaaatctttctctctaattctgaaaaattattttctaaatcttgaagcatttcaggtttgtatattctaactaaaagcaaaaataaaaaaataataacactaacaaaaataaaacgctctatattttgatatataaacaaaaaaggaggcgccagagcgtctcccatgtattttccactgaaaaattttttattcaaatttcagaacaaacattactgctcttgtctgcaatgtagaaactgcagatgcccagtaaggaggtgtagttgcgttatccgccactttctcattgttcatgaagaatgttcctctgatcgcaggagttagtttaaacttattgaaataaaactggattcccatttctgcagaccatgcaaagttgtgggtggtagatctgaagatcccctgcatgttatcatctgtagaagttgcattagactgaaggtttactacgtagtttacccctgctgcaacgtaaggtcttgagttgtaccatctttgtccgtgaagctccagaagtaccggaatatctattaatgtagatttaatttctcttactttatccttttcctgtaaagggaacggtatgaagggatcatttgttaaagatccacctgcataaatatcattggattgagtattaaaagtcaactgtctttgtgcaaactgtaaacctggctctattcttacgtctaaatagtcgttcagtctccattttgcaataagcccggcaccgaaactataactttccttagaggtaacaaggttttcattatcattcatcccatatttcggatgtaaaacaatgcggtaatccagtctgttcccgttcaaataaaacccccaactgaatttctgttcgtcgaaatcttccaacttgtccattctgtttcgggttctgaattgcgcgtttgcaaaaacggcaacatttactgaggttaaaaccagtgcttttaatagaaatttattcataggttactttgttgctttataaattgtggctatacctaaacttaattttttatattcaactttcttaaatcccgtatctaaaagaatttgcttcatcttctccccgaaaggaaaagcatttacagaatccggaaggtatgtatatgccctattatccttggaaaccagtctgccaatcgcaggcaatatatttttgaaataaaacatataaaatggtcccatgaaaccctcaacctttgaaaactccagtatataaacacttttgttatctttaactactcttcttaactctgccaaacctttggtaaggttctcaaaattccttactccaaatgcaacggaaaccgcatcaaatctattgtcctcgaaaggtaaattttctgcatctcctttttgcatggaaattttgccgtctaatttaagtttttttattttaataacgccaacattcagcatttgttgtgataaatctaatccaaccactttagaaccggttcctttttcaatagttattgccagatctcccgttcctgtagccacatccagcacttcctgcggattatcatttttcatccattttaccagtttatttctccacaaaacgtcaattttcatggataaaacatggttcagaaggtcatacttcggtgcaatgttgtcgaacatatcctctacctggcttttttttgtagcctctgaattgtagggagtaactttggtgatatcttttgtcaaaacttaaaacttgtaatattctttgtaataatttaggtaatcctgctttctgaagattttggatctcgattccactttctggatattcttgatcactttgtcatagtcttcatccacattgtaataaaaatcttctgtgtaaagtttattgaagtgtctggcccctccgtaataatcctttccgtcaatgaccgttttatcaagattggccagtaacgaatcttttttaaggttataaccgtaatactgatcattaatgtagtaatcctggtgtgtaatattgatcagaccacgaagtttattaacttcaaatgccgagtcatacagcatttttttgttctgatcaaaaacctgaatagagtttttccctttattcaaatccacatgcacatactgccccgctgaaataattccttcagatccgttgttgatcttgaaatagtaggtgttcggggtaggattatctacaacataataattcttcttggctaaaaaaaggaagtagatcccaaaggcaacgataaacgccacagctgcaataagtaagccttttaaggacgagttgtttttcatagattgtaaagtacaatttttgcaaatttaataatatttttaattctccgttattaatattaattattaactttgcaactttaaaaaaatcatataaacgaatgccgaatacgatcattattggctctggatgttatattccgaacagagttattggtagagattacttcatgaattctgagttctacactgaagacggagtaaagattgaaaagcctgtggaagaaaccattgcgaaatttgtagagattacagaaatcgaaaacaggagattcattgaggatcatctttccaactcacaaatcggttatgaagctgcaaaaattgcccttgaggatgcaaaagtagatggcgaggacctggattatattatttatgcaagcaattttggggaagttactgaacacggatatgctgattttatgcctaccatggcagcgagagtgaagaacaaactgggaatcaaaaacagaaagtgcgtaacctacgatatgcttttcggatgccctgggtgggtagaagccatgatcctggcagataacctgatcaaagctaaagtagccaaaacgattctggtaataggaggtgaaacattaagccgcgtaacagatcctcacgacagaaacagaatgatttttgctgacggtgcaggagctgtagtcgtaaaagcaacagatgaagaaaatgtgggaattatcgctcacaatacaatctgtgacaatggcccggaactgaactatcttgaaaacgctccttccatcaataaagaagtagatcagagacgtctgtatgtaagaatgttaggaagaaaaatctatgaatacgctctgaaaaatgtaccggttgccatcaaggatactattactgatgccggtctttctattgaggatatagacaaaatcttaattcaccaggccaatgctaaaatggattacgccatgattgaaagacttcacaagctttatgatgtgaaagaatacgaccatgctatctctcctatgacgatccaggatttcggaaacacttctgtagcaacaattcctaccatgtatgatttaataattaaaggaaaaatggagggtcaatcgtttaaagaaaaaggtaacattgtgatgacttcggtaggtgccggaatgaacatcaatgctatcgtatacagatttccttaaaaatatttaataaacaaaaaaatataaagcacagggaagttattctttgtgcttttttttgatcagacatgcaaaagaattttttaatcattgccggaatcttcctctttttggaagtatatatttaccaggctgtcagaacgcttaccgacaacctttggatcaaaatcggatattgggttatatcattagctgtgtatggaatcttcgcttatgaagttacccattaccagcgatcagacagaagcatggtaagggcccagatcatgatttcattatttttgatttttattcttccgaaaattttcgtggttctgtttttattaattgatgatatcatcagaatcggaggctatcttatcggtttttccaaaccttcagaaaacttcttcccggaaagacgaaaattcctgagccttgtcggattgggaatgagcggggttctttctgctcttttcatagatggaatcacgtttggaaagtacaggcataaagtgagaagagtaagggtaaatttcaccaatcttccgaaaagcttcaaaggctataaaatcatccagatttctgatgttcacagcggaagcttctctgatccaggcaaattagagcatgccattgagctgatcaatgaacaaaagcccgacctggtgttatttaccggagatatggtgaataatgttgcggatgagtttaaaccctttattcctctgttttctaaaatcaaggctaaagacggcaagtttgcggtcttaggcaaccatgactacggagattacgtaacctgggaatcgcctgcagccaaaaaagaaaatcttgacaccctgatccgctatgaaaaacaagccggatttgatatgttgagaaacgagcacaggattattgaaaaaaacggagaaaagctctatattctaggtgttgaaaactggggattaaaacctttccctcaatttggtaaaattgatgatgctttaaaaaacgtaccggaatccgccacgaagatcctgatgagccatgaccctacccactttgattatgtggtaaaaaaacatcctgcaaacatccatctaaccctttcgggacacactcatgggatgcagtttggtctggatcttaaaaatgtaaaatggtcaccggtacaatataaatatcctaagtgggcagatttatatgaaagtgaaggaaagctgctgtatgttaacagagggtttggagtattgggatatccgggaagagtgggtgtattgccggagattacactttttgaactgagttagagaggcggggtccgggatgcgggttattggttgctggttgtttggttgcgagtgagtttattccgggttacgtgttgcacacaacatcaaacattaaaccttgaacttaaaaccttaaaccctttacctaatccctgcaatctaacccctacaacctatcacctaaaaaatataatctttcatacgggaagtagccatttccctgtcattgagaaaagtaaggagggcatctaatttgtcctccatttttttacccgaaaataagctgcggtaaaaaggaatatcaaaacggtattttttaaaatccgtaaactgccatgtgttaagatagatcagcacaaattcttcattctgcaaagtctccagcaccatattctgataatatttcatcggcaggatctggaatacgaagtcattatagggcagctgactgtaaggagagatactttccgggacaatactcagtccgtcctcttctgtaatttcggtatctcttttgagtcttttgaaaggaaaaagaatattggcattatcaatattagaaacgtaattgaattccatcagcttcagaatatcctgcggaaccttcacatctttctggcggattcccctgatctgtttttccagcagatcctgaatattctttttggcattttcaatttcttcaggatttgaacctttattataaaaagcaatttcatgccctttggatgaaattgcttttattaaattctgaagtttttcagtaagagaaatctctacaaaaaaacttgatttgatatcatgaatatctaaaattctaagaattgctttggtattattttctatgattttcaatcgctcttcatcggcaatccggaagcctttttttacttcagcttcaatacaagtgatgttaaacgtcaataataccatttcaattaaattttatataaacattttaatacattaaaaatcagatgttaaaaacatatttatttaaagtattactttacattattaattcttacctaattttactttcagatttttgatcatatctttcgtcatttcagaaattccgaaatcatacgtcagaccccagtcttttttcgctaccgaatcatcaatagaagccggccatgaatctgcaattgcctgtctgaaatccgggttataatcaatcgtaaaatccggaatttctttcttgatttcttccgccagttcttttggggtaaatgacattccacccaaattgtaagaagaacgaaccgttaaactttcttttggagcttccattagtttcaaggttgcattgatagcatcatccatatacagcattggcattcctgtattctcggaaataaagcttgtatattttccgtcttcaatggccttgtagaaaatctcaacagcatagtcagtagttccacctcctgcaggcgtcttccatgagatcaacccgggatacctgatacttcttacatccactccatgtttgtcgaaatagtattcacaccacttctcccctgccatttttgaaatcccgtaaacagtggtaggattcaacactacatcctgttccacatcatgctttggaattccttttccaaatacagcgatagaacttggccagaagatctttttaagaagcccttctttcgccatttcacaaaaatgaaggagtggttcaagatttaatttccatgcgaaaatcggctgtttttccgaagtcccggataaaagcgaagcaaggtgatacactgtagtgatatcataatctttaattacctgtcttaccaattgcgtattggtaacatccattctttcatagtgtccggcagaagtaattccttcctgccatctgtccagtcctgaagcaacaacattttctgctccgtggatttcaacaagtctgtttgtaagttcggtaccaatttgtcccagggcacctgtaatcagtattctttccgtataggattccattttcagatttttttagaattgtacaaaagtaaaaaaaacatgtcaaccataataaaaaaggtgtatttaaaaacatttctctgataaccatcttcatcttcaattaatttcaatgaaagaaaaaatcaaatgcaatgatcatcaggctgtgattcactgaaaattcaataattttgtttcaagaaaaaacaatcatatgaagaagattttaattgcttcgatgctgttggcagttcagttcagctgggctcaattcacagatatcaatattatcaaggaagtacaggtaaaaaacaaaggtgtggtagtctctgcacatcctttagccagtgaagcgggagctaaaatcttaaagatgggcggaaatgcttacgacgctgttacagcgacacagtatgcgcttgccgttgtgtatccgcaggccggaaatattggcggcggtggatttctggtaggggtcaaaaacaatggggaaaaattcacattggactacagggaaactgctcctaagaaagcttcacgggatatgtatatcgacaaaaaaggaaaagcagatactgatctttctcaaaacggaagactcgcagtaggcgttcccggaagtgtggctggattttttgctaccttgaagtattgcaagctgccgatggaaaagatcatccagcctgccattgatctcgcagaaaaaggatttgccatcacagataaagaggcagaaatgctgaacaaccaaagagagaaatttcagaagcacaataaatcttctatcatttttgtaaaagatactccctggaaagccggagatctgttaattcaaaaagatcttgccgagactttaaaacgcatccagaaatcaggagctaaaggtttttatgaagggaaaacagctgaactcctggttgctgaaatgaaaagaggtaacggaattatcacgctggaagatcttaagaactataaagttgcagaaagaaaagctcttgaatttgattataaaggaaatgatgttgtcaccatgcctttaccatcaagcggcggagtgctgcttgctcaaatgctgagaatggcaagttttgaaaacctggaaaaatatcagcagaactcaacaaaagcagttcagattatggctgaagcagaaagaagagctttcgcagacagagcagaatatatgggggatccggattttattcaggacaaaacttcttacctgatttctgacgaatacctgaaaggcagatggaaaaatttcagttttgataaagctactccaagcgcagaagttggcaaaatcatagaacagcctaaggaatcgatgcagactactcatatttccgtattggataaggacggaaatgccgcttcagtaactacaacccttaacggatattacggaagtaaagttttagtttccggagcgggattctttttaaataatgaaatggatgatttctctattaagccgggagtaccgaatatgttcggagctgtaggtggtgaggccaattccatccagcctaataaaagaatgctttcttctatgactccaaccattattcttaaaggcggaaagccttatatggtggtgggaactcccggaggaacaacaattccaacatcggtctatcaatctattgtgaacgttgtagattttaaactgaatgccaatctctcagtaaatgcaccaaagttccaccatcagtggcttccggaaaccattacggtagagaacaatttccctgaaagtaccatttctgaactgaagagtaaaaattatgttattgaaaaaacaaaatatatcggaaaaacagaaatgatcgttcttgatgaaaatggaaatattcatgcagtggcagacggccgtggagatgattctgttgccgtggaataaacaggtcagattatcaaaaaatacagtttcggcttcattcttcgaatggagccgaaacttttttaccaccttataagaccattcctatagattcttttcaatgacttttgtcatgttttcagataaattttcttaattttcgcccttaaaaaaacaaaacgactgttctttgaaagcaaaaaaaatatacaatcagctttatttccaggtgattatcgccataattgcaggtattcttcttggaaaattttatcctgaactgggagaaaagatgaaacctttaggggatggattcatcaaattggtgaaaatgattatcgctccggtaatcttcattacacttacgttgggaattgcccatatgaccgatttaaaaaaagtaggaagaattgcaataaaggcaatgatttactttttcactttttcaacccttgctcttattatcggattaatagtaggaaatattctacagccgggacatggtttaaatattaatccttctactctttcgggtgacgtttcacaatatcaggccaaagctcatgaatctactcttacgggttttattatgaatattatcccggagactttattcagtcctttggtgggtgataatattcttcaggttctgctggtggctattttaatgggagttgctttggttttaacaaaagaaaaaagccagaaagtaactgattttttacaggatctgtcaaccccggtttttaaaatcgtacatatgcttatgaagcttgctccaatcggagctttcggagcaatggcttttacgatcggaaaatatggacttcattcagtactgaacctgatatttcttgtcggcacattctatattacctctattctttttgtcgttatcgtattgggggctgtggcatggtataatggatttaacattttcaaatttctcttttaccttaaagaagagcttctccttgtcctgggaaccagttcttcggaatctgccttaccgggaatcatggaaaaacttgaaaaagcaggctgttcaagggcaattgtaggcctggtagttcctaccggatattcttttaatcttgacggaaccaatatctatatgactcttgcttctctttttattgcacaggcattaaacattcatcttcctattgaaaagcagctcatgctccttctggtagcgatgttaagttcaaaaggtgcagcaggtgttacaggcgcggggtttgttactcttgcagcaacattggctgtagtcccggaaattccgattgcgggaatgaccttgattctcggaattgacaagtttatgagtgaatgcagagctttaacaaacgttattggaaactcagtagcaacagttgtcgttgccaactgggaaaagcagctcgacaaaaaccagcttcaatactgcctggaccatccgcatgatgttgagaaaaagcttgaagggtaagcaggtagcaaatgggagattaaggtagcaggttttaggttgaagggattagcaattaaagactaaaccaaaaaactttaaaccttgaaccttggaccttaaatcagaatattcagacttgaaggctgtaccttaatgtgaatcggtgatttaattttattgaattcaccatccagatgccagtttttggtattgactttaaatgatatttcagagacaggaagataagtgacatattcatcatctttcaatcttttggtaaacattctgaaagcaaaaagcgcagaatacgtaagcggaaatttcttcaccagaaccatatcaaccaaaccatcacttttgctggctttgggagcaatgtatgcattgttaccaaactggcgggtattggcaatgttcatcatcagatatcttccattgtactgctgataagcttcatcaaaaaactttactttaattggcttataattgaagaaagtcttcagggaaactttgatgtaatttttgaatccgcggcttgttttttcaaattcctttacaacctttccgtcaaaacctgttcctgagacattgatggaaagcctgtcgttcacagtaaaagtatctattttcctggagttttttgcttttattttttccaaaagttcatccaggtttttgctgaatcgtgtctcattggaaaatccgtttccagagccggccgggaaaattgcgaggattttctctgtattaataaggtttttagctactgtagaaatagtaccgtctcctcctattgccacaaaaatatccacttcctcaaaatgagcctgaataaactcatctgttccgggaatagattctgacacgtaatacaacgggtctttcacctttgttttaagttcgttcaaaaacggctgatagttttttttggccgaaaaaggattgataataaaagctactttgtccatcaccacaaaattaaaaaatgcttccagaactggaagcattaatttatttaattttcattctttctttgaattctgcatttaaggtacctttcagatcttcccatgaaacaggaattgtaatatcaccggccgcgaaagctgcaatttcataaggactgtagtgaaaatacaggtttttgtcatcaaaatagaaattatcagaagccggaattttatctaccaataacatttccgaattcttaacttctccgtcgccatccatcgttccgctgttaattttatcgatatttttcatcagaatggcttcaattttatttttaggcattgaagtaatatcttttaattccagttttctgctgtttttaagatcaaaaaccctttctgaaaatccgtaattatcatgagctcctccttcgtaaccgcttcctaaatactggatatgcatataaccatttttattggaaatcaggttcatatgtgagcttgaataccaattctgggcatacgtcacatctgaaagccagtctttattatcgttttttacaacattgaaatagtcattcttttctttatcaagataagcctgaagcccggctttggaaaagtctttgattttttcattctggaaatagatgctgtccagcagtttcttatcttttaaagtagggaaaaccaagagctttgaagtgaagctcacttttaaggaatctgtaatttttgtagaatcatttacttttacagaatctactacaaattcttctgcagctttgttttctgttttttctgcctgtcctgttgtttcgctttttttacaggcagccacggccaggaaagaagataatgctataacagcaatcgtatttttcataatttattttttgatatcaaatacaaaaaccattcaaaagatgaatggtttctgaaaattttttattttttatttaaatcgtactaaaaaattactttttaacaaggctgatcacctgattttcaaattttgaagcaactccccagatttgtttaaatgcgggataatattctttcggatagtctgaactgttaacctttgtggttgtagtcacctccagcttatttcctttttgttgtacagaataggtataggctatttctttatcttccgttacaatctttttctctttaggcatttcctcaatcacatatccatcaggaatttcaagaattacctttttaactttggttataggagatccgaaatcgataggatattttcggacttcagtctgatcaaattcattggaattcttatttaaaaaaagcattggattaataatcattttctttcctactctgtcaataaggtttgttgaagaaaacttcatactgctttcaaattctccgttttccaatacttttgaatcaatatccgtgaaatctattgagaaattctctttatactgctttttatatttttccggattatcatcatagctgtctttaacatacatggcataagcaccagtatctttgtctgaataggttccggaaatacttccgtcatcattaattctggcattcacggtaaggtaagtattgcttgatttcagattagccatttgaatctgcagtgccttatctttggttaccaggattccatactggttccagtttttaaggggaatttcatccaatgaagactgcttggaggtggcatcataaatatgtaactgatcatccagcttaacagtagccaatacaaaattcatattggatacgttaggagacaccagattgataagaccgttttctacggtagaaataaccaaaggatcagctttaagaccagcttcgcgaagcatcatcacaagaaaaagattaatttctgcatcattccctgttttggtttccaaaagcttcttaatcccgtcttcagtataaattcctttatctttattccaggtaaaagttttctgtacgtatgaaaagatagcatttgccttttcaaggtcagtcttcatttccgaaactccggcaggcatattttcttttgcaagttttgttcttttcagttctcctccaaagtcttcactttcataaagtctcttggcaatctggtcccatgaagatgaatacagcttaagctcaccaaaattggtagagttcagctcggcacttatttttgttctgaaattcctgtcatttcttacaaatttctccgttttaaagccggttaaattttcataagcaaatctaaaggttttatatgaagtaccatacaactgcctctcctccatttccctgtatttaggtgtaagtcctccggtatagtttacattataagacatattgatgggtgcatctaaaacatactctgtattcagtgaaggggtatcagattctatcagcacctcaggaatcataaaccggaacggagatacaatttcatactgatattctataaccgatccgttttttacgcctggaaaagcaaattttgtcagcgtaacatatttattctctttacttttatattgagaactcttttctacctttaaaggaacagccgctccattctcaagattgtaggtaaatgccttgaacttccccagtgattctctgttgcttccaacattataaataggaatttcgagattcaaccagtcttcagctttatctttatcgtatatcttcactctataaaaatatcttttgtgaagattaccggtattggcatctaccataaaataagcagatttgtacaaaatttcggcaggtgcattttcatccaacaaagattttgctttggacagatctgcctcgttaaatttaggtggattcagaaattcatatttcttttgagcgttgagtaatattgcattggcagagcatagaagcaatactattatttttttcatggttatatttttgttattaaaatttttgaattgtccatattcagaatcttttttctgaaattgatatagtcattatacttttctttcggatataatcctttattaatctgtatcttccgggtcaccattacctgtccgtcacctttaacaaaacttagcttataggatccgaattcagaagtgatatttgagttgtcaggaatttcatccactttatagcctaaaggaagaacaaaagcaatttcatactcgtcctcataagacatccctacttcaaaaggaagctcacggttttcatccgttttaaagacagcatcggtaaaaattggtacagatctgaaaagaaggctgtttccggctttcttggagaaattattggtcttgaaatccagatcataagtaataacggcattgtctctgtcgttattaaaatttttcatttcaactttttcaaagtttaaaatgtcaaacctcctttttatagcatcatttttttccttaggatcaagattgacaaaacttaagttgtagtcatactgatttccggtataggaaaagctgccgcttcctgtaatactgttatcttcattaaggttgactcttaatttctgtttttccttattctgttccgctttataaacaggtgtattgataagttctattcctttcggagtcacagcaagtacatttctgtcggtggtactgtaacttaaatggttgaaagcaatttgctgagaggtattttccagccatatatttcctttttctgtaggaaccataagaataatatggtttccacccatagcaggaaattccggatcaaaggaaacctgtgaccgtccggaattgatgatacaataattagaaggaattcctgcttcattcaaaagaatcttcatatagttggtaagtcccttgcagtcaccatacccttttttctgaacttcatccggcagcatgggttgccagcctcctattcctaatgaaacagctatataccgggttttgttctgcatatactgataaattttcttaactttatcttcaacagaaccctgtaattgtaaagacgcaacctcagctttaatagcaggagtagatgcagaaacaggaaccagaagatcattgtaaatccaggttccgaaatctgtccagttattcaaagttccctgctttcctgccagactgaattttgccagagcaaagttgaccgcaggtaagattttaacaggctgtgggatcataaaagcatcatcaatggcaggtacatttttataggtatatgttttatcattgccactgccgctttctatcacggaggtataattgtattttgaagggtaaattttagatctgagttctattcccgaggtgttaacaattttaaactgtgcttcttccagtgctattttagtagaagtaaagggcacaaaatccgggatgaaaacagtatcttcatcttctgcttcgtaagaaaaatcaacagtataaggatattgaaccggtgtatatgaataaaccaatatcctgttatcagaataaaaaactccctgagggttgttcgctacatctttaaaatcagactttgaaacacttttaattttcttccctgattcatcatagattgtaacctttatattcgaaatactttttgatttatcataaggaatgtaagctactgcctcctcgtccccatctttattcaaaactgtagataccttattatactgatattttatttcatcaattttgttgatctgaacggttgtaaaatcctttcgtataacaacatcagcgtttttctttaagtttaccggaatcgcagaagcaggatagctttgtgcaaaatataatgaggcggtagataaagccccaaggactaatattttcatcatagttattaagatgatgcaaaaataagaaaatcttaataactgttaaaaaaaatataaaaggcttcaaccagtgaagcccttaacctaatacttaaaaaagtactgttttgaaatgtacctataaggctatgaacacattatcaacttttcatgaataatttctgaaaagttaaagcagaatatttttattcattctatattgaaagaagaatatgtattctaccgcatgaagggataagcttcatattgtctgcatttcaaatttagaataatttacgattcatataattcaaaaggtgtagaattaatatgaaacagaggtaaaattaattctacaaataattataacaataaaaaagacctcattgctgaagtcttttaattttctctttcttatattatttaatcatttggaatacgcttgtcatcgaattgatcacttccaagtcccaataccggaataaaaataaatccgaaaaggagaatcagaatcgtgtaaagcggtgtttcttttccaaatcctttggcaagtctgtcatatacaacccagcatgcaaaaatattgaccaatggaataaagaaaaggatgatccaccagattggttttttcacgatttccagcaatacgattgtattataaataggaataaaagcagcccaggcatcctgtcttcctgctttctgaaagattttgtacatgcaatatccatagaatatatagcacaataatcctaagaacatagctcctattcctatgcctgcagcggctgcgccagacactgcatctgtcccgttataaggatctgtttgtaaaagagttaacatattatttgttttttgatttgtccaaatataaaaaaagcttccaaataatcggaagcttttttattatatttttaaaaacgtttatgcatcaatttttgcatattttgcatttttctcaataaattctcttcttggcggaacctcgtcacccatcaacatggagaaaatactgtcagcttccactgcattatcaatggttacctgcttcagaattctgtgttccgggttaagggttgtttcccaaagctgctcagggttcatttctccaagacctttgtaacgctgtacttctaccccttttccgtccggagacatttccagagtaaactcttcacgttctttttcgttgtaagcgtatacttttttgtttcctttctttaacaggtataaaggtggttgagcaatatagatataaccgttctcaataagctctttcatatatctgaagaagaaagtaagaatcagtgtagaaatgtgagatccgtcaatatcggcatcggtcatgataacgatcttgtggtatctcagttttgataagttcaatgctttgctgtcttcttctgttcctacagaaactccaagagctgtatagatatttctgatctcttcgttatcatatactttgtgaagcatagatttttctacgttcaggattttacctcttaacggaagaatagcctggaagtgtctgtctcttccctgcttggctgtaccccctgcggaatctccctctacaaggaagatttcagattctgccggatcttttgatgaacagtcagatagttttccaggaagaccggaacctcccatcggagattttctctgaaccatttcacgggctttcttagcggcttgtcttgcttttgctgccaaaaccactttctgaacgatctgcttcgcttcatttggattttcttcaaggaaattagtaagcatttcccctacaattttatctacagcaccagaaacttcagagtttcctaattttgttttagtttgcccttcaaactgaggttccattacttttacggaaaccacagctgttaagccttcacggaagtcatctcctgtaacttctactttttccttctgcggaattcctaaatcatcagcatatttcttaagggttctcgtcaaagcacgtctgaaacctgccaggtgagttcctccttcatgggtgttgatgttgttaacgtaagagtgaagattttcgttgaaagaagtattgtaacgcattgctacttctaccgggatatcatctctttctccttccatgaagatcacgtgctccataatggattcacggttaccgtcaatgtaagcaacgaactctttcaatccgccttcagaatggaaaacttctgaacggaaagatccgtcttccaatttttctctttcatcggtaagggtaatggtaatccctttattaaggtaagaaagctctcttaaacggcttgctaatgtatcgtaattgtaaactaattctgtaaatatagtatcatccggctggaaaaactgcttggttcctcttttttcgctgtgaccaatctcttcaacaccggtctgcgcttttcctctggaataaatctgctgataaacgtttccgtctctgtaaacagtagtgatcatctcattggaaagtgcattcacacaagaaactccaaccccatgaagaccacccgaaaccttataagaatctttatcgaacttacctccggccccgattttagtcattacaacctcaagggctgatttctgctctttttcgtgaaaatcaaccgggatacctctaccgttatcacttacttcaattccgtttccttccttgatgctaacgaagatcgtatcgcagtaccctgccaaagcttcgtcaatagagttatctactacttcataaaccaagtggtgaagtcctctgactcctacatcaccaatgtacattgaaggacgcatacgaacgtgctccattccttccaatgcctgaatactactagctgtatattgtttttgactcatataaaatattaaaaatcctgctcagtgcaaagacttacaaatatcgtgatttttttcgaggtatgaaagttaaaaagtgtcaaaaaaatgtggagttttctttagaaaaacataaggattagtgagccggtaaaagaaacaaaattaaaatgtattggtgagatagcaactgttgtaaatcatattcatcatcaataatttatgcgtaaatttatttactgaaaagttgaaattatggatgattttatagcagcacgtgctcagatggcactttctctgggctttcatatcatattctcctgtgtgggtatggtgatgccattcctcatggcttttgcccattggaaatatcttaaaaccaacaatgaagtatataaaggattaacaaaagcgtggagcaaaggagtggctatcctttttgccaccggagcggtttccggaacaatgctttcctttgagctgggacttttgtggcccggttttatgaaacatgccggtcctattttcggaatgcctttttctctggaaggaacagccttttttattgaggcaatagccattggtttctttctgtatggatgggaaaggttcaataaatggtttcactggttctgcggatttcttgtggggctaagcggacttgcctccggaattctggtggtggcagccaactcatggatgaattccccaacgggttttgattatatcaacggacaataccttaatatagatcctatcaaagctatgttcaatgatgcatggtttcctcaggctcttcatatgacggttgctgctttttgtgcaacaggatttgcagtcgcaggagttcacgcttttatgatcatgcgaaaaaggaatattgagtttcataccaaagcgtttagaattgcggtgggttttgccctgattggagcatttggtgcgcctttgagtggtgatgttgcagccaaatccgttgcggaaagacaaccgatcaagcttgcggctatggaggcgcattttgaaactgaaaaaggagcttcattcgtgattggaggaattcctgacgagaaaaatgaagaagtaaaatatgcagtgaaaatcccaaaagttttaagctttctggtaagtaatgatttcaattccgaagtaaaaggtcttaaggatttcccgagagatgagtggcctccgattgcagttgttcattatgcttttcagattatgatcttctttggtgtggttatgattgttatcggagctgtctatttgtatgccttcttcttcagaaaagaatggctgagtaaaaactggctgttaaaaaccttcctcatcgcaacgccttttggatacattgcgctggaggcgggatggaccgtaactgaagtcggaagacagccatggattatctatggcattatgagaactgcagatgctgtaaccccgatgccgggaatacaatattcattctatttcttcaccgcaatttttgtatccttatcactgattctgattttccttctaaaaaggcaaatccagatggtaccaaaactttatgaccctaccgattctcagtttaacgataaaaacaaaaaatcatgatttacattgtaataggttttctctggctatccatttgtctttatattattctgggaggagctgactttggagcaggtattgtagaaatgttcaccaataaaaaagcccgccataaaacccatgagattatgtatgaatctattgctcctgtttgggaagccaatcatatgtggctgattattgccatcgttatcctttttgttggctttccggagatttataccactatgtctacttatcttcatattcccttagtattaatgcttttaggaattattgcaagaggaacagcttttacgttcaggcattatgatgctgtgaaagacaattggcaggttttatatacgcagatattttattatgcgagccttttgactcccttctttttggggttaattgcagctgcaacggtttcccactctattaatcctgatgcaacaggttttctggatctgtatgttttcagctggctgaactggtttggggtttctgtgggtttatttactgtagcattgtgtgcttatcttgcgtctattttttcattaagagaaacccgtgggaaagaagaattgctattaatgataagaaaatcaaaacaaacaatgatatttgttgtgattacaggaattctggtatttgctactgcttacctttcagatattcctcttttgatgtgggtattttcaaagcctttgggaattatggctattgcttttgctactgttgctttactgcttattttaagagcactgaatacccaaaaattacttccggtgagagctcttgcaggctttcagatggtaatgattcttgtggccgctacctatcagcataatccggatattattcttttaggtaatggacagcatctttcattactggaacatatggctcctgaaaaaaccatcgctgcattgggctgggcattgatgctggggtctttatttattctgccgtttttattttatttgatggcttctttcagtaagcttagaaaataatattatgaaaggttataaagacaaaactgaacttattgaagaaattaaaaaaaggttccttctttacaacaaggaattcgatgatattaaagaaaatgaaaaagattggctaaaagtaggggttgataaaacaccagcccagaatatatcctaccaggttggctggacccaactgctcctacagtgggaagctgatgaaaagaaaggaaaggaagtaaaaacacctgcccctgaatataaatggaataatttaaaaggattatatcagtctttctatgagcaatatagctcctataatctggcagaacaaagagatctcttacaaaagcaagtcgatgaaattataaaatggattgaagaccttgatgataaaatcctgtttgaacctgagcaaaggaaatgggcaacaacacctgctaaatggcctgtatggaaatggatacatatcaatacagttgctccttttaaaaattttagaatacagctccggaaatggaaaaaagaaaaaggtacagaataactctgtaccttttatttttatttctttatcaattttgtctggtgcctcatttggccattacagaaaataaattcgggattaaaggctcgaagctatataaaattatctacttcctactttcagctgcccatctaattttcttaaataacctaatcaggatccagattatttcatgatttatttttaaaaaactcatcaattttctctgcgcattgtctgccttccgcaatagcccatactacaagactttgtccttttcgggcatcaccacaggtgaaaattttatcctgattggttttatattctttattatttccgattaagttcccttttggatccaggtgaatatctaatgcttcaaccagccctttatgctcaacatgcgtatatcctaaggcaataaaaataatatcacattcgagtacaaattcagatgctggtttttcagtatataagttccattttccttcatcagaatctttagtccattctgcttccaccaggcgaattccttttaggtttccatgttcatctttcacaaattcttttgaattcacagaccacatacgatcacacccctcctcgtgggaagaagtaatctgcagtagcgcaggataagtgggccatggcatcgtttcatcccgttctgttggttgcataggtttataataaatctgatatacaatttctgctccctgacggttagaagttcctatacaatcggaccctgtatctccacctcctatgaccactactttttttcctttcgtattaatttcttcttcttcaaaaggaatcccgcttacttttttattactttgtttaagaaaatccattgcgaaataaataccttttgcatccctgttgggaatgaccagatctttgggaacagtacttcctgttgccaatacaattgcatcaaaattacggttcaattcttctacagcataattgacaccaacgttaattccggtacaaaattcaactccttcttccttcatccactgaactctgcgctctacaatatttttatccagtttaaaatccggtattccaaaccttaataatcctcctatttcaggatctctttcaaaaactgtagtactataccccatctggttcaattgatatgccgctgccaatccagcaggtccggaacctactaccgcaacttttttatctgttttcagcttgggaagtcttggcttggcaaaacctttctcgaaagctatttctataatattcttttctatttcctcaatggtaacggccttatcgttaattcccaacacacatgcactttcgcagggagcaggacaaattcttccggtaaattcaggaaaattatttgtagatattaaaatctgatatgctttttgccattgttttttatatacggcttcattaaattcaggaatgagatttcccagcgggcaaccactctggcaaaacggaactccgcagtccatacatcttgccgattgacaattcaactgctgatcagaaggcttctgaataaattccttataatcctttagcctcttttcaacatccagtttagaaggaagttccctctcatataataaaaatccatctatcttccccattaggtaatatcatttatctggttttcaatcactttcttatattctctcggatacactttcgtaaagtgcttacaactgttatcccaatcacttattatatattctgccaatgtgcttcctgtattttcaaaatgttccttgatcagattaaagatcgattctttatcatcctctgtaatagattccagatccgccatatcaggattaaaatgatattctaaggttttatttacatcccatacataagcaatacctccgctcattcctgcgccaaaatttcttccgactcctcccaggacaataactttccctccagtcatatattcacatccatgatcaccaattccttccacaactgcagtcgctccggaattccgaacggcaaaacgctctcctgctatgccattgataaatacctttccggaagtggctccatataaagcaacattgccaacaatactattttcattggcacggataatagcctctttatgtggaaaaataatcagctgagcaccagaaagccccttccctaaataatcattagcatctccttccagacgcatagttatccctttattacaaaatgctccaaagctttgccctgcggttcctttaaaattaaacagcaatgaatgttcattcattccctcagacttataaattttggttaattcgtgggaaagaatagtaccaactgtacgatctgtattttttatatcaaattcggcttccatcgatgtattattttgaagggcgtattgagccgcttcaaccattttccaggaaatggaatgatccagacccacatcctgttcttcagatttaattaccggcaaatcggtttctattttataaagcatcctgcttaggtctatcctttgatgtttccagaaggtaatatctgtttttctttcaagacattgagactgccctaccatttcatcaatggtcctgaaacctaaattagccataatctcacgaacttccatcgcaagaaatttaaaatagttcaccaggtgttcagcttttcccttgaatttttttcttaattcgtccttttgagtggcaattcctacaggacaagtattcaaatgacatttcctcatcagtatgcagccttcaacaatgagcgcagaagttgcaattccccactcttccgcccctaacaaagtagctatagccaaatcgcgtcctgttttcatctgcccatcaacctgcagagtaactctttgtctcagtttatttttgatcaaagtctgatgggtttcagccaatccaagctcccaaggcaaaccggtatgacggattgagcctaaaggtgatgcacctgtcccaccatcatatcccgaaatcagaatatgatctgcttttgcctttgcaaccccagaagctatagttcctactcctgcttttgaaactagcttcaccgataaccgggcatggcgattagcattttttaaatcaaagataagctgagctaaatcttcaatagaataaatatcatgatgtggcggcggagaaatcagtccaacgccaggtgtcgagtgtctcgttttaccaatccatgaatccactttatccccggataattgcccgccttctcccggcttagcaccctgagccatttttatttggatttcatctgcttctgcaaggtatctggcagtaaccccaaatcttccggaagcaacctgtttaatggaagaacggaggttatctccattcttgtcaggtgtatatctgacttcatcttctcctccttctcctgtattactttttgcccctatcctgttcattgcaattgccaatgtggtatgtgcctcccacgaaatagacccaaaggacattgctcctgttgcgaaacgtttcattatgttttctatgggttcaacttcttccaacaaaatgggttttctgtcatttttaaattccagtaatcccctcaatagggaggctttacccatttgctgattgacaagtcttgaatattttttaaaaatgccatagtcattgttccaggcagactgctgaagtaagtgaatggactgtggattaaactgatgatattcattattacttctccaccggtaaatacctcctgtatccagtaatgagttttccatatcttccctgaatgcatcctgatgttttatcaaagcttccttcgcaatttcatcaaatccaataccttcaattctggaaacagctcctgtaaagcacgtattgaccacaagtttattcaaccctataatttcaaaaatttgtgctccatgataagattgcaaagtggaaactcccattttagaaaatatctttaaaagcccatctcctactgcctttttataattatcttttagccttggtaaatcctcttcttcaaattccccatcatcaaacatttgtctgatacttgccaatgccagataaggattaattgccgttgctccaaatcctaataacgttgcaaaatgatgaacctcccaaacatctccaacctccattaccaaaccgatctttttacggataccttttctgatcaaatgatggtgtactgccgaacatgccagtaatgaaggaatagatgcatgctgagaatccagtgaccgatccgaaagtataatgacttcaaacccatcatctactgcatctaccgcatacctgcaaatcctgtcgatcgctttttttagttcaccttcttttccttttgcgttaaaataagtataaatcgttttggcttgaaatctacctgtatcaacacttcttaatttttcaagctgattattattaataacagggttgtccagtctgatagaatgtgcaaagtttttatcctcttctaaaagattgccatttcctcctataattgtagtcaaagacatcaccagtttttcccttatcggatctatcggtggattggttacctgggcaaataactgtttgaaatatgagcttaagtgctgtggcttctcactcaatacagctaaaggagcatcaaaccccattgacccaattggttctttaccgtgagacgccatttctttaatcactccatccagatcttctctggaatatccgaatgctttctgatacttaaaaatatcttctgtctgaagtttattgaaccgaattttagggttgggtaattcggtgatattaatcctcatactttccaaccattcacggtagggttttgaggtacatatttctttttttaattcatcatcactgatgattgctccttttttcatgtctacaagaaacattttacccggctgaagatgcccccttctaattattttttggggatctacagataatgctcctgattcggatgccataatgaccaaatcatccgatgtaatacaatatcgtgagggacgaagcccgtttctatccagagtagctcctattatatcgccatctgtaaacgaaatggatgctggcccatcccagggctccatcaagcaagcatgaaactcatagaaatcttttttgtaatgttccatctgctcatggccatcccatgcttcaggtatcagcatcatcattgtatgaggaagcgaccgtcccgaatggtacagcagctctaccatattatcgagatatgaagaatctgattgccccggttttgttaaaggaagaagcatatccatttcctgaggagtaaaaaatgggctttggaacattttttcagaagatctcaaccaattaagatttccccctaaagtattgatttcaccattatgcgctaaaaacctgaatggctgtgccaggctccatgtaggtgaagtattggtggcaaaacgggagtgtaccattccaaatgcggaacgaattttaggattggtaaggtctttaaaataattccgaacctgaatacttctcaattggcctttataaataagctttttacaggagaaagaagctacataaaacccaataggatcattatttgtaatactggtcatctgatgagaaatataattcttaaaaataaatagctttctctcaaaatctttttcagtatccacatcaaaaggacgctcaataaaaagcatctccatcactggttctacactctttgccaaatctccaagatcaatattactcaccggaacaggccgatatcctaatattttaagatgtaacttatctgcagactgtgcaatgacctctttacattcttcccgaataaaattattctgagaaaaaaataacattccaacaccgtaatatccagattccggtaaatctattccgacgtttaatgcctcatcatataaaagctcatgggggatctggatttgtatccctgcaccatccccggtattactttcatatccggtagcaccacgatgctccatgttctccagcatggtaatagcatcacttacaatcttataactttttactcctttaatgttcgctacaaaaccaactccgcaggaatcaaattcaaattcaggttcataaagaccctgatttttttaaaattttctggatttttttttcgtgttgtattcatctacatgttcattttcatatcaaatgtagtaaaaagaacaatcttaaagaatttaaattacatttattttattaaaaagcattcaaagcatagttttatcctaaaaaaacaaaacaataaataaacataatatcaagaatacagcaaaaacataaatattagataataaagtatatttttttattgaggctaacaccggacaattaccggattactttaaggaattactgctggaaaaaagaaaaaggtacagcatagcactgtaccttttttatttatattttctgagaaattctaagctaatttcatcaaaagattttcgtcaattttctcaactttcacaatattgttctttgtcaaagttttggaagctttatcccattttttaccggataactggcttctttcttttacttcagccaaagccatcggctcttcctgagaattaaggatttcaaggattactttttcgtcctcacccaattcaatctgcggtgcagctttttccggtctcatctgagggaagaataatacttcctggatagaggcattatttgttaagaacataatcaatctgtccattccgattcctaatcctgaagttggcggcataccgtattccaatgctcttaagaagtcctgatcgataaacattgcttcatcgtctcctctttcagacaatgccatctgtgcttcaaaacgctctctctgatcgataggatcattaagctctgaataagcgtttgcgatttctttaccacacaccattaattcaaaacgctctgttaagccttctttgcttctgtgtttctttgttaatggagacatttcgatcggataatctgtaatgaaagtcggctggatgaagtttccttcgcatttttcaccaaaaatctcatcaatcagttttcctttacccattgtctcattcacttcaataccgatagacttagcaaaatcatataattcctgctcagtttttccagtaatatcaaaacctgtaaatttcaggattgcttctgtcatagaaactcttgggtaaggcgctttgaaatcaacttcatgttccccaaaggtagcttttgtagtaccatttacctggattgcgcagaattccaataatttctcagtgaaatccatcatccagttgtaatctttgtaagccacatagatttccatagcggtaaattccgggttgtgggttctgtccattccttcgtttctgaagtttttagagaactcatatactccgtcaaaaccacctacgatcagtcttttcagatataattcgttggcaattcttaaatataatggaatatccaaggcattatggtgcgtgataaacggttttgctgctgctccacctggaatcgactgcaggattggagtttccacttcaaaataacctgcatcattaaagaatgttctcatggcattgaacagttttgttctcttcacaaaaatttcttttacctgcggatttaccgttaaatctacataacgctgtctgtatcttaattcaggatctgtaaagccatcatgtaccactccgttttcgtcagttttagcctgaggaagaggacgtaaagcttttgtaagaagcgtaaagtttttcactaaaacagtcttctctcctacctgcgtggtaaacaattctccttcgataccgataatatcaccgatgtccaaaaggtgcttgtatacttcgttatatagttctttatcttcacccggacagatctcatctctgttgaaataaacctgaatttttcctttagaatcctgcaattctgcgaaagaagctttcccctgaattctgcgggacatcaatctaccagcgatctttacctgtttactttcagaaaaatcctgttttatagattctgtagtatctgtaattgtatactcatccgcagggaacgcattaatccccatttcagtaagcttgttcagcttttctcttctaatgatttcttgttctgataattgcatttcttatttttctaaaagcgtacaaatttaggcatttttgacttgaccgtcaatggcttttttaagaaattttaaaaagtggtaaagatgcgggatattgggttcgggataggtgtttagaaatgcaagattacagatttgaatgattgtgctataaccttaaactttgaaccttggactttgaattttaaataaaccagctttttctgtctttttgaggaataaatgtccaggcaagtattctgcttattttttgtccctgggccatatcgatggttttcacttctgcagcttttactttctttaaaagattcgtcagtttattgagattatcttttttagaaaccaggcatgtaaaccaaagcacctgtgttgaaaataatgcactttcatgaatcatctttgtaataaatgccagttcaccaccttcacaccatagctcagactgctggccactgaaattaagaagaggtttggatttctttgattgatgaagattttttgtttttctgatatttcctttcatggcagactcctccgaatcatgaaaaggaggattgcacattgtaaaagttaatctgtcttcaggtttgataatattgacaaagatatggtctgcatcaggttgacttttcagctgaataaccgaggaaagatcttcattttgatccagaatatgctgggcattttttaaagaatcctgattaatatctgttcccagcattgtccagccgtaagatctgtgactgattaaaggatagacaagattggcacctgtccctatatccagaccttttacagaattacctgtgggaatttcatcaagctgttctgccaagagatcggcaatataatgtacataatctgcccttcccggaatgggaggacaaagattggtgtccggaatatcccagcctttaatatgataaaaatgtaagagtaaagctttattgagcagtttcactgcttttggaatgctgaaattaatggttaccgtttgataagcatttgtaaaaacatagtgtttcagttccggcacacaagaaataagctgatcaaaatcataaggattacgatgcaggtttcttgtgtgcagactggatttttcagcggacatattttatttcttctgactcaaaatatattccaccatttttttggcatcttcttttgacacctgtggatgggcagccataggcacacttccccatactccacttccgccttctataattttggaagcaagcagctcggtatccttttcagaatatttccctgcaatttccttataagaaggtcctaccattctttcattcacagagtgacatcctgagcaatccaatgtttcgatgatctgatcaccggaaagattagattttgccggttctgaaacagtagatgtttcagaagaagctgccacttctgctgtattttcttttttagaacaggaaaggatcataaaacccgttattcctgccaaaagtatttttttcattatttcttcgctgtagaatctgttttagcagcttcaggtgcaggtgcagccggagttgcagcagctggagcagcagttttagcagtagaatctacaactgtagttgcttccggttcctcaagcattgtgttgctatcctgtaaagagtgatccggcttttttttgcagcctgtcaataataaacctccgataaatgcgattgctaatacttttttcatttttttctaatttggaagcaaaaatataaaaaataaacttttaaacttatgacaaatgttttctttgaggaaatatttttaaggtcatcatcttaatcaaacaataaaaataattcaaacatcggagaattttaaataagttgttatttttgcagatcggataatccgaaccaaaactcaacgtattaattgaaaatgtatgattaaaaaaaatgtatcaggtacaacgctctttgttgtattggcttccctccttctgtcatgtgacaactcctcaaacgagccgcaatcagaatattctgataaaattgaatcggtaacgcttttaaaaacaacaaaatcctgggacgggacaacgtatccagcctatccttcatcacagccggaaatctcggttcttaaaattgccgtccctcccaattcggctctgaactggcataaacatccggtcattaatgcagcatatgtagaaaaaggcgaaattcagattgaaagaaaagaagatggcaaaacacaatgggtaagaaaaggtcaggtactgcctgaaatggttaataccggccacaggggtaaaaccggcgaccagggagcaaccctgattgttttctacagtggaacgcctgacattcctttgtctgagccggtacaataaatagttcaaacctatgttcgcaaagtaattatcataaaactctatttttggttcgcaagggtacttcgttcagctaatgacaacgtcttttgctgagtgaaacgctcttgcaatcgttttaacagttatttaataacatctttgcgatctcagcgtttacataaaagattattatagttatctttaatccatggttttaatttcaaaaattctgtttttcgtcagtcatcatggtttttatactgtgatcctgctgctggtattctttggagggctttcatacctcaccaaaaaagcctggcttttaattcctatcattcctctggcaatattaaacggattcggaggacaatttctgaatgcgtggtttttaaacaaatatggtgttgaaagcacagctattatcacctctgatgtagaaacaaattctactctgaatgacatgtacattcatgattacgaagccattgtgaaaaagcaagacggaaaatataccactacttttttctctaccactactgcagccatctaccctatcagaaattcaatcagaatacccggtgataaggatatacctgtaaaatacattccgggctatgaaaaaaatattgtcatcctttatgaccaatccagggaaggaaaaattttactgcaaaatgaaaaactggctcctgttaattctgcaaaaatcaaatacgaggcagacaggacgaataaggaattcattaaagaatatattgatgcccttgaaaattatgtgaaagactatgatgatgaaaattacaataagaaaattgaggaattgcgagaggagctcaaacagcttaaataggagattcttatgttaagtttttttattttctgattttttttcgtcctggtatcaaaaaaatttctacatttgtcccatgttaaatatgaacaacaataattggtggtggctttcaaactcttcgtcgggtctgaaggtattgtcatgttgttaattacagcagaaataatcaaaaaacaatatataggctttgacggataccgttgaagcctttttttattcataaatcttaccaataaaaacaaaaagatgtttacagacacaatcaaaataaaaactgtttcgaaaaaaacactgggagaccttcatactcccatgaatatttacctcaagatcagggataaattccgtgatacgattcttcttgaaagttcagattcaaaaagtattgataataacttttcctttattgcggtaaatgcgattgccggaattgaagtaaaaaacctcaacgaatacgaaattaaacttcctgcatctgctcctgtaaagcagtttattatggaacgaaatatcacagatatttttgaagattttcgcaatattttcaaatgcgaacccaccaatgacgcaatagagcagaccgctcagagcctttttgggtatacgagttttgaagccttacagtttttcgaaaacataagccttaaagcacaaagcaaagaagttgaaattcctgtcctgagatacagattataccaatatgtgattgctatcaatcatttcaatgatgagatgtatcttatcgagaattttattgatggtgtaaaatctgagcttcaccttttggaaaaccttattaaaaatcagaatactcctgtttatcctttcgagaaaacaagtgaggaaacctccaatattacagatgaagaatatattgaactggtaaaaacagcccagaaacattgtatgcgcggagatgtttttcaactggttctaagcagacgatttgaacagaaattcaaaggagatgaattcaatgtttaccgtgctttaagaaatattaacccttccccttacctcttctattttgattacggaaattataaattattcggttccagccctgaaagtcagttaatcattaaaaacaataaagccattatccatccgattgccggaacatcaaaaagaacagggaattttgaagctgaccttcaagcaattgaagttttaaaggcagatcccaaagaaaatgcagaacataccatgctggtagatcttgcaagaaatgatcttggaaagcttgggaaaaatgtaacggtgaccaaacttaaagaaatccagctgttctctcacgtaattcacatggtaagtgaagtgactgcagatgtttctgatgacattaatcctcttgaaatggtgtctgccacttttcctcagggaacattaagcggtgcaccgaagcataaagcgcttcagctgatcaaccaatatgagaaagattcccgtgggtattacggtggctgtatcggaattataggattgaacggaacctgcaaccaggccattatgatcagaactttcttaagtaaaaacaatacattattttatcaggcaggtgccggattggtggcaaaatctgtccctgaaaatgaactgcaggaggttaacaacaagctcaatgcactgaaaaaagcagttgaaaaagcagaaaaaatagtcgaaaaataaactcaccagctatcaaccagcaacaaaaaacaaccggcaactatctaacaaaaaaataatgaacaacactataaatactcagcagccacagcttaaagttctcgttttcgacaactatgacagttttacctataaccttgtccagattattgaaagaattctgaatcaaaaagtagatgtggtaagaaatgacgaaatcacactggaagaagtgggaaaatatgacaaaatcattctttctcccggccccggaattcctgaagaagcaggtattttattagacctaattaaagaatatgctcctacaaaaagcatctttggcgtatgtctcggacagcaggctatcgcagaagctttcgggggaagcctgatcaacctgtctgaaatctttcacggagtagctaccacaactgagctggtgaaagaaaataccaaacttttcaaagatttggattcaggattggaagtgggaagataccacagctgggcagtaaatccggaaggtttcccggaagagctggaaatcactgctgtagataaagacggaatgatcatggctttacagcacaaaatatatgatgtacatggcgtacagtttcaccctgaaagcattttaacgccggaaggtgaagtgatcattaaaaatttcctattgtcatgaaaacttcagaaaatccttcagcaaccataaaagcacctcaaatgaaagaaatactgcaatacctgtttaatcataatacgctttcaaaatcagaagccaaggctacaatgattgaaattgctcaaaataagttcaactccgcagaggttacggccttcatcagtgttttcctgatgagaaatattaccctgaaagaactggaaggcttcagagaggctttactacaaatggctgtttctgtagacatcgattccagtgatgccattgatattgtaggtacaggaggtgatggaaaagatacgattaatatctctacactcgccagctttatagtggccggagccggccaaaaggtaacaaaacatggaaattacggagcttctaccactacaggttcatccaatgtactggaagaattaggatatcagtttaaaaacaactcggaacaattgaatgaggatcttgaaagagccaacatctgctttttgcatgctccttacttccatcctgcgctgcaatccgtggggttgttgagaaaatctctgggattaagaacattttttaatctgttgggtccgttagtgaatcctgcaaaacctaaatattcaatgatcggagtatataatcttgaaattgcccggatttaccagtatctacttcaaaaggaagaacgtgaatttattctggttcatggtctggacggatatgatgagataagccttaccggcgacagcaagatcattaccaaaaacggtgaggaaatctattctgcggaagatttaggtttcaatccggtaacattggaagatattaaagctggtagttctattcaggagacagcaaaaatatttatgaatatcctggaaggaaagggtacggaacaacagaactctgtaatccttgccaatgcatcaacagcactttacaacacccataaattcgggacgtatgatgactgtcttttaatagctcaggaaagccttcaaagcggaaaagcattgaatagttttaaccttttgattcattaagattcaccattcacttgcaaagcaaaattcactattgaccacattacagacacacaaaatgactatactggataaaattattgaacgaaaaaaagaggaagttgctgcagcaaaattacgcatttcccttgaccgattaaaagacaccgctttttttggaaggccaacatattcactgaaagaatccatcaaaaataaaagtggaattatcgctgagtttaagagacagtcgccatcaaaaggaatcatcaacaataatgttgagcctttagaagttgtttctgcttacgaaaaatttggagccagtggaatttctatcctcactgatcatgattttttcggaggaaatttaaatgatgttctcagtgtaagaaatgaaatcaacataccgattctgcgtaaagatttcatgattgatgcgtaccagttttatgaagctaaaagcattggtgctgatgttgtactactgatcgcatcttgcctttcaccagctcaggttcaggaatttacagacttagcccacgaactgaaaatggaggttttgcttgaaattcataccgaagatgaactgaaacattttaattcaaaaatcgacttagttgggatcaataacaggaatcttaaagattttaaagtagatctgcagcattcggttcagctgaaaaaccagcttccaaaaggcgttttttcggttgctgaaagcggtatttacagtttggaagattttcaatttttaaaagaaaaagggtttgacagcttcctgatgggtgaatattttatgaaaaatacaaatccggccaaagcgtttgaagaatttgcttctcaaatttaaaataagtaataatgaacctgccaactccgaccataaacctacaacctctgctcaaagtctgtggacttacaaaaccgggccagattcaggaattgatttctatgaatgtagatttcctcggttttatcttctatgaaaaatcacccagatatgttttgaatcacctgagtgcggaagaaatctcagctattgatcatcatggaaaaacaggtgttttcgttaatgaagaattggatatcattctacagatggtgcaaaaagccggattaaattttgttcagcttcatggcgatgaaagtgatgatttcattgttgaactaagacaaaagctgaaccctgaagtcggtattattaaagtcatcagaataggaaacaatgcagatgaaaataaaatgaaaataacgcagatttttaactttcaacggacaatctgtaacctgcaacctatcacctattttctttttgatactgacagcaaagcctttggcggaacaggaaagcaatttgactggaatatcctgaatgaacttgagattcccctgccctactttttaagcggtggcatttcagaagataacatcgaaaatattgaaatgctgaagcaacagccttttgcattggatatcaattcaaaatttgaaacagagcccggacataaaaacattgacaggataaaagaatttaaaagactctgtcaacccaataaataactaaaaaaacacacaatgatgaatatacatttgctaaaaaagacattttacaaaacactgtttccgcctaaattcggaaatgaaaaaattcagaccctgtaccattttgttgcggagaacgacagtaacacggaacattgggaagcaggcggattattgtctgatttcatctgtattattaaagattttgaagaaggagacatccagtatttttttgaaagaatcagcctttggaacagctattacctggttattatttcggataaatttttagaaaaccatgtcagatcagtagtaaagtatgacttaggattaatttatgctaaaatatttttactttatgacgattctgattcttattatttgattgataatctcgaaattgccatcacgatgtatcagtcgaaaatagataaagcaaccttaatagatttactgcacaaaattgagttgttatattataaaaaactgatcaccaaacaacaatatgattaccatcttacatttattaatagtttaaacgcatgaaatatcagataaaagaaactcaggatttaaaggaaaaggaaatagaacatattttgcagctatgggatatttctgcatggaacgccatgaaatctgcctattttattacttttttcaaagattcggaatttcatttcctgctggatgtggatgaaaatatactggcggttatgcgggtgaattttgattttaccttaaaaatagcagataatgaatattcctttgcggaggtagtaggacttgtttccgctcataaaaagaaaggatatggagcagcgttggttcgtcatttcaaagaaaatgccacacaaagaaatctggaggcgattggtttctgccattcagaacttcgtcctttttatgaaaaatgtgatattgaaatccttcatgacaaagccaaaatgatcaaagaaagtatcggctcggaatgggtgaattctgaagatgatgatattctgattttttatacaacgcaggaaagaaaagaactgctcagccagcttagttctcaaaacaatgcttacttaataactaaagaataaaaaatgaattataaaaaccccgatgaacacggatattatggagaatttggaggagcttttatccccgaaatgctctatcccaatgtagaagaattacaaaagaattaccttcagattatagaatccgaagatttccaggcagaatatcaggatttgctgacaaattatgtaggccgcgctacaccactatattttgctaaaaacctaagtcagaaatatcagactcagatttatttaaaacgggaagacctcaaccataccggagcccataaaattaataatgccttaggacaggttctgttggcaaaacgacttggaaaaaccaggattattgctgaaaccggagccggacagcatggtgttgccactgcgacagcctgtgctctactgggtttacaatgtatcgtttatatgggagaaatcgatatccagagacaggccccgaatgtagcgagaatgaaaatgctgggtgcagaagttgtggctgccacttcaggttcaaaaaccttaaaagatgcagtgaatgaagccctgagagactggatcaacaatcctgtgacaactcattatgtgatcggaagcgtggttggtcctcacccgttcccggatcttgtggcacgattccagagtatcatttcaaaggaaatcagagaacagcttaaagaaaaaatcggaagagaaaatcctgattatgtgatcgcctgtgtaggcggtggaagtaatgctgccgggactttctatcattttgtagaagaaaaggaagtaaaaattattgctgcagaagcaggaggactgggtgtagattcaggaaagtctgctgccactacatttttaggaacgcttggtgtacttcacggaagcaaaagtcttgtgatgcagactgaagacggacaggtcattgaaccgcattctatctctgcgggactggattatcctgggatcggaccttttcatgcgaatttattcaaagaaaaaagagcagaattctttagtattaatgataatgaagctttaaaatgtgcttttgaactgaccagactggaaggaattattcctgcattggaaagttctcacgcgctggcagttttagacaagaagaaatttaatgaaaacgatgttgttgttatttgtctgagcggccgtggggataaggatatggagacctatctcaaaaatctgtaaaatgtaaaaagtattcatgtaaaatgactttaacagataaaacctgatcataaatacattttatgtgaatacatcaatacaaaaaaagaaatgaaaaaactaaatatatacttcacagcaggaattccacaactggaagataccgctgatattatacagctgattcaggattccggagcagatatgatcgaaatcggaatgccttattctgatccggtagcagatggccccgttatccagaaagctcacgaactggctttacaaaacggaatgaccattgaaaaactgttgtcccaattaaagaacatcaaagataaaatcagaattcctgttattctgatgggctatatcaatccggtattgagtttcggatttgaaaagttctgtgcagcatgtgcagaaagtggtgtttcaggactgattcttcctgaccttccccctattgagtttgagaaaaattatcaatctgttttaaagcagtacaatcttaattttacctttctggtgactccggaaacctctgatgaaagaatgatctatctggattctttaagctcaggatttctgtacgcagtaagttcttcctctacaaccgggaatgaaaatgccgttttaaaaaatgaaaactacctttccagattagcttccctcccactcaaaaatcctgtgatgatcggatttggaattaaatcgaaagaggattttgaaaatgtaacggaaaaagcggatggcggtatcataggaacagcctttgtgaatattttgcttcaagataaaaactggaagaagaatgccatagattttatccattctgtaaaagggtaaaattcactaaatttgtatatcaaaaattgcaatgaatacaaatcaaaataaagtagtagaatttgaagatttagggatcagagaatatcagccggcctgggattaccaggagcaactgatgaaaaacatcattgataccaaaataaaaaacagagatcttcctgcggaacagcataccattacgcccaatcaccttcttttcgtagaacatcctcacgtttataccttaggaaaaagcggacatgaagaaaatatgcttgccggtattgataaactgaaagaaattgatgctactttcgtgaaagtaaaccgtggcggagatattacctatcatggctacggacaggttgtaggctatcctattctggatcttgaaaacttttttacagacattcatttatatatgagaaatctggaagaagtgatcatcagaaccattgccgaatacggcattcagggagagcgctctccgggagaaacgggtgtttggctggatgtgggaaaaccttatgcgagaaaaatgtgtgcgatgggagtgaaagcctctcgatgggtaactcttcatggcttcgcattgaatgtaaatacagacatgcgctattttgaatacatcatcccatgcggtatcaaagataagcaggtgacttctttaaaaagagaacttgaaagagaactgaatcctgtagagatggaggaactgaaggcaaagatcaggaagcatttcgcagatgttttccaggcagaattgatttataaatagtcaagtttaattacaatataataggcccggtttcaatagttgaaaccgggcttttagttttatcataatgttatttttattcgcatagacgatccacaacgttgttattctgcaggaatctagactcagaaatcctgtaataataaatgaggataaaataagagtttagattcctacggaatggacaaagaataaatagacttatcttattaaagaatatttgtatgtcagaaataaactatccaccttgtctattccgtaggaatccagatctcgaattctattttaaaattcttctggcctttcagaattatactattcttaagattgttttttagatttaatctatattacatagcttagattcctacggaatggacaaagaataaatagacttaccttatagaagaacatttgtatgtcagaaataaactatcgatccaccttgtccattccgaaggaatccatacctcgaaattcattttaaaattttctatgtttcaaaattctactattcttgagactgttttagatttaatccatattacatagtttagattcctacggaatggacaaagtataaatggacttatcttattaaagaacatttgtatgccaggaataaactatccatccaccttgtctattccgtaggaatccagatctcaaaattcattttatttttttgtctttctgaattctaccattaaaaacttcagatttttcagctattttcaatattataaaatcaaaacacaacagaataatgtatttttttcaaaaaaaatcttgtatatattttaatttttattacttttaatatcacaaacaagtgaactattacaattaaagagttcactaaaactaaacaccaaaatataaaaactatgaaaaaatttctgttatccatgatggcattcgtgacgattctgtcattcaatgcctgctcagattcaagtgccaaccaggacccgaatcttgtcgctaaagaatctaacgaagtcgttatgaaagatttcggtaagactgttccggtagggattgaaaaagaagatggaaaatttaaaatctcatttatggttactgcccagccgtatgaaattgcggacagtaaagaaaatgcaggctatatttccatgatcagacaggctgttgagaatgaaactcccgttcatgttttccttaaagccaacaccaataaaattgcaaaagtagaaaaagcaacagatgacgacatccgttattttaaatctgtattcaacaagcaagagagaggtgaaagcaacaaagcagtcagtattattcctgatctggcaacactcaacagtttgtttacccagatcaaaaaccaggcttgcggaacttctacagcatcttctccttgtatcaccttcagatatccggttgacggatgttacgcaagggctcacaaaatgagacaaatcctattgaacgccggctatgactgtgaaaagcagttcgtatatggtaatctgagagcttctacaggaacatgctgcgtatcatgggtatatcacgtagcaattttggtaagcttcaaaaatgcttcaggaattgttgaaaaaagaatcatagatccttcattattctccagcggtcctgtaacagattctgcatggagagctgcatgtaccaacacaagctgtggatctgcttctgtatcttcctacgccaatacagcaggaaatgtttattacagaagtccgtcaggttcattactgtatgataacaactatgtgaataccaattgtgtattaaacatattctcatccctttcaggatgttctccttccccagcaccaagtgtagcaagctgtggattttaattaatttataaagaactcctgcaattattttgatacattgcaggagcttttttatttaatactttttcattatgaaagcctggtcctatttattattactttttattatgattgcatcctgctccggtaattccggttcacagaatttaacctggtataataacgctactatttcagatatcactgcagatccggataaacctgatgaagtagtgcgtgttgccattggcatcagtgctcaggtattttatctttccaaaaaatctccggattataaagctcttatggaaaaagcaacccaaagctttaagaaaagtaaggcatataatataggtattgaaaataaaaccaatatcattaaagaaatgaaagagattcaataatcgtattatctgattactgaaatacctgcatctacttttacttctgctccatggatatatgatgcctcctccgaagccagaaacaatactacattagctatttctgaaggttctccctgtcttttaaaaggtatggtaggaattatatcttcgatagcgctttcaatttgctctccggttaaacctgtattgttaaaaatattggttttaatatgaccggggcttactccattcacacggattccccgttctgtaagttctacagctaaagttttgatgaatgactgcaccgccgattttgcagcagaatataccgaaaaattaggcatggcaatatctgttgctactgaagtattgaaaataacggagcttccgcttctcatcaatggcagcatctgctgtacggtgaaaaaagggccttttaccaaaacattgaagagttcatcgaagtgattttcatccacatattctacaggagcaaattttccgtatcctgcattggcaaaaaccagatcaacctgctcagtatattttctaacctcctgctgaagattcataagatctttcatatttccggcattggacacgattccgaaagcatttttttcaagcttgtccaaagcaatatttacagattcttcacttcttcctgtaataataaccgttcctccttcttcaatgaatttctgagcagtagccagccccattccgttcgttccgcctgtaattagtgcggttttgtttttaaatctctgcattgtttttagtttaaattctatggcaaagattgcaatactattgttttgaaaaaatccagttcttgtggaattaagagaaaaggcgaaagggcaagactgcgaaaaggcaaacggttaaatggtaaataatgcgattattatttgcgatttagcaatttaaccatttagcctttttactcttttgctttttaccattttaaagttcatcaataattgtcatcaataaaatcattcaaaattaaattgcacacaattaaattggctataaatttgtattgttaaatcagctgaacataaaagctgaaattttaaaaatcaacaagtagtttaatttaaaaacaaaaagaaaaatgtcattaatagaagatctgaactggagacatgctgtaaaagcatatgatccaaccaaaaaagtttcacaggaagaccttaacactattttagaagctgcaagactggcccctacttcatcgggattacaacctttccgggtaattgtagttgaaagccaggaactgaaagaaaaaatggtagccggagcattaaaccctgaagtgatgagagattcttctcacgttttggtgtttgctgcatgggacagctattccaatgaaaaaattgacaaggtttatgattatcatactgacgtaagagatcttccaagaggccgtttcggaagttatacagataaaatcaaagaaatatacggtgcacagactcctgaagagcattttgcacacactgcccgccagacttatattgcattagggattgcccttgctcaggctgcagaacttaaaatcgacagtactccggcagaaggattcagcaatgatgttgtggatgaagtactgggactaagagaactgggattaaaaagcgtaagtcttttgtatcttggataccgtgatgaagctaatgactggctttctactatgaaaaaagtcagaattccaatggatgaatttatcataaaaaaataataccttcatcgaatctttcgtactcaaaaaaattatggaaaatcctaaaacacccaaactggaaaaccagatctgctttccactgtacgtgatcgccaaagagattacgggactttaccgtccttttcttgatgaactcggcattacttacccacagtatcttgtgatgatgatattatgggatggagacggacttaccgtaagccatatcggggataagctgtttctggacagtggtacactgacgcctcttcttaaaaggcttgagtctaaaggatttattacccgaaaaagaaaaaaagaggatgaaagagtagttgaagtatttttagacgaagcgggcaggcagcttcagcagaaagcctgtgaaattccggggaaaattcaggaaaaactaggaatacaaccggaagagctgctgcaccttaaagacacggtactaaaaatattaaacaaaatagaaaataaatgaaaacgttatatacaacccaggtcactgcaaaaggaggccgaaacggacatgtaaagagtgaaaacggtgtattggatcttgatgtaagaatgccgaaagctttaggaggcggcaatgatgattttgccaacccggaaatgctgtttgcagctggatattctgcatgtttcgacagtgctctgaacagagtaatcagcctttctaaggtaaaaaccggggaaacaatggtaacagcacaggtaagcataggacagcttgaaaatggcggtttcggactggcagctgaacttgatgtgaacattccaggagtttctattgaagaagctcaggcattgacagaaaaagcacaccagatctgtccttactccaatgctaccagaaacaatatggaagtaaagctttctgtgaccaacaacgattaatccaatttttttaagcatagttataacgaaaggagctgtttccatggaaacagctcctttttattttttatttaacggcagattacgcagatgagcacagatgattgtggatatttttatgtatatagtatttaagaatgtcaatcatcatcaccttctgtctttcatcagatcgctcttctgataggcgtctacttttttataggaatcgttcttctctttttcttttttatcagagatcaggattccaaaaagatggtcgatttcatgctggaaaataaccgctgtaaagccttctacaatttctgaatatttctgccctttcagatccacatattccagctgaataaccttacttctgtaaaactggtctctgaaatcagggatagacaaatcaccttcaggaccaagattctgcagatcggaacgccagacaatcaccggattgataaagtattccagtggggctccttctttatcaaaacgctgtacccagatgatttttctgttgattcctacttgtggagctgcaatgcctactccgccatctgttgaaagaagagattctttcatcctttttaccagaactgcaatattgggatcaagaggatctgcttctgaagaaatgttcagcaatgttttatgctgattggaatctgtggtctgataaatcggcaaggccgtattcacatcaccctgattaataattgagagctcatgggaagtaagtttctgggcgttgagaaatccaataaaaaagatcagcagtacggaaagtttcttcatgttttttcaaatgtgataacaaaggtaaaaattgtgttgtaaaaataatttatttagcaatgaattttaagttttggctaaagccgttgcctcttttaattaaaaaaagccgggctaaagcccgaccctattgaatattttttcctaataattgaaagtctaaaaagtcttggtcatatccgcgggaataatcagattgaaatctgtcgggatataatctttggccggcactttcagttcaggatcttctgattcaaaaacggagataacagccattttcagattaggatttttctgtttgatataccagtagattccaccaaattctttgctgtgatagttcccgttataatggacgaaagtttttccggcctgatggtttttaagaatagattcagccatcgttgcatcttttgtagcctgggctgaaataaaattcatcacttttgttccttccgcatggtctcccatcatctttttcatttccggatatcccggagtgtctaaagtcactttgataggcagctgcgcaatataagttttctctttttcgcttaatgtatttaaagattcaaggccttctttggcggtttgggaggcatatcttcttgggatattggtagcaataaacttcagctttttatctttggcaaaatctaccaaaggtttataatctgttacgtagttattccataaacgggcagaatccttgaatgttttggcatcaaattttccattcagatactgatccagctgagcctgattgtctctttcaaacatttcagcccctaaaataagctgtccgttctttttcgcaaacaaagcttccgtaatttttagctgaagccaatggttgatggaactgttatgattttcaccaaaaaagaccacatcatattctgccaactcttttaccagtttttctgtctttacttcctttccttttttatcataaaactgatatgctttaaagtcctgagccttcaatgaacagaagccggctatcagtatcgctatgaaaatatttttcattttgtttttataattttaccacaaattacacaaatattctggcaactgcagatcgtttgtcataaaaaagaccgctttgaatcttacaaacaaaacggtctcattcaaattatctaattattacttttctaaagctgcaacaagatccttccattcctgaagttcaggaattccgggttttctctttccaaagaactggacgataaagtcaccttctttgttgaatacttcaatagcggttacttccccgtcttcagttggtttcttaacgatccaggcttctgcaattttcgttacatcaaggtgcaggttgaaatccggatccatcacgttgaaccactgctggtgccaaagtgttttgtttacatttcctgtgtggatctgaataattcctctgtttccaacgaaaaccatgatcggaacgtttttctctgaagcgtcttcaaggatatttactactttggcattatctattttcttagcgaatccttccggagccagtctcaaggcctgcgttctgcttactccgtattttctggtcatcatgaagaaatcatgagtgtctttcagttctgtccatgcttttttgaagccctccacatcaatttccgaatctgctttttcagcctgctttggagctacagcctcaaatacaaatgcctggttctgatcttccgctttaaatttttctacaattgtttcgaaagcggtttcattactatcttttgtcagataaatcttatgaagtgccaatccgtcttttccgaaaaactgaaggcttttcttatctccttctactactgcaaaagcaaacttccagtggttaaggaaaattcttagatcgatatcttctcccacaaaaagctgtgcatgcggactgctgaaatcaccattcagataggttccttttctttcatgaacacactcatcgttacgggtaagtgccattacttttccgagttgcccggcttctgtaaggattccctggaaatccgggttcagcaccgttacgccttctcctatgcctgtcactaataattctgcttcacttactcccagctgtgcggctgcatttcttattctgatatgtggattttctgctttcagagcttcccatttttcctttaaatcattaactaatgtgctcattactttacttttttatggttaaaattgtatatattcttcgtatggtttcgtttcctgttttactttttatttcttcttctttttcagaagttttcattcttttgaaatggcttttggaggtcagttcttccatttcgctgttgctgtataaggtgaaattaaattccgtaaacggtaatttttccatgaactctctttgcccgaatgtaagaacgaacgttccgtcatctttcaaaaccctgtagatttcatttaaaaaatccaccggattttcccagaaatacacggtgttaactgtaaatattttatcgaaggtctcatcctgaaaaggaagcttttttccttcgtacaacacaaattctgcctgactttcaaattctttattgagccttttagcttcattgtgcatggtttcagaaatatcaattcctgtgtacctgaggtttttggcaagattcattatacttttaaggtgtccggcatttccgtgccctatttcaaggatttgctggtcgtcatctatcgaaagtgttctgatactttctaacgtcatactgatgttagtggcattcatcatttcaccaatctcgatgcctttttcaccctgaggattggcaagattctgtgcgaggattttgagttcttctttttccatggttatccaaaaatgatcattgggttattcgtaataggatggccgcagatggtacatggaaagttgtaggctttactgatattttctgccgtgaaaacttcctccggagttccatatgcggaaacttttcctgatttcattaataaaatcttgtctgcaaattgagcagcaaggttcagatcatgcaaaacaacaatggcactgttggcttttttcgtgaattttttgatgatttccaacgctttatactgatgtttaatgtctaaattattcaacggttcatccaggaaaaccagtttatggacaacttcattctgtaactgcgccattaccctggaaagatgtacccgttgtttctcacctcctgacaaagaattatagtctctgtccttcaaatgaaaaatatcggtttcatagagcatattattcatcgcttcaagatcttcttttccgggctgggcatcaaaataaggataccttcccatcatgacgacatcttttacatcaagcggaatatcattgctgttgtgctgtgaaaattttgctttatgttttgaaagctccttcacattccattcctgaatagacttatttttaaataatactttctgctttccggatttcacttcatctgccagaacactcagaagacttgacttccctgctccattcggacctacaatggctaaaaattcgccatattccagggagacatctactccatccaggatacggaattctttatgtttataattaatctggtgtgccttgatcattacagtgattttttaaatttaaccaaaatagcaataaagataggtcctcccatcaatgcagtcagtattccgatcggaagttcggacggtgctacaatacttctgctgaatgtatctgccgtcaacaataaaatacttccacacattgctgataaaggcaggataaaggtattatcggatttgaataaaagccttaaaatataaggtacaatcaatcctacaaaaccaatagttcctgaaaatgctacgcatgttcccaccattaaagctactgtgataatgatctgctttttcaatttctccacattgattccaaggtgctgtgcatctttttctcccagcatcatcgcattcagagcttttcctttaggtaataaaatgatgtaagctatgatcattacaacggtcagaatgatattcttcgtccatgtggcagctgccagactcccaagattccagaaagttaaatctctgagctgttcatcttttgaaagatagatcagaaatccggtaatggagaaaccgattgctgttatcgccactccggtaagcagcatcatcactacatttgtctttcctccgcttgttgaaattctgtacacaagcatcattgataaaaaagaaccaataaaggccgctattcctaccagtgaaaactgtaccgcttcaggaagatattctttaaaatgtcctcccaaaacaatcgcaatagctgccaacaatgtcgctcctgatgtaaggccaatcaaatctcctgttgccagtggatttttaaaaagcccctgaaggctcgttcccgaaactgaaagcattcccccaattaaaatggccataacgattctcgctgctcttacatcccagatcacatatttatcacttaaggacaaagacggatcaccttttataaattgccacaggatcatgaacggggaattccctccgaaatcataaactccggtattaagtgacaggattgctatgatggtaagcagtactgcacttatgataagataaaagtatagtttactttgtgttttcaattaaaagtttatttaatgctactgctgcttctcccaatctcggtccgaaacctgataccaaacctccgtccattgcgataatcttcttatttttaccggcattggtttgtgatactcctggcattttaaggactccttcatttcctcctgctccctgtaatcctgtttcgaagaagaataatacgtcagggttggcctttacaactgcctcgggtgtcaatggtttgaaatcttcaaaatcagttacggcattttctccgcctgcaaggttaattaatgaagccattggtgtatttttaccgcttaccatcagcatatttcctctggcatagatgaacagtacttttggctttttagcaatgggctgtacttgtttcagatcagcatcaattttatcatttaatttctgataatctgtatttccgattgcttttgcaacctgttcgatcagttttttagttccttcaaccgtatattcctgtttaaaaacttcggtttgaattcctgaagatttgattttccccatcaattcaggattgatatccttatcagaagcaaggatcaatgttgggtttacagacatgatcggctcaatcgtcatcgatctcatatggcccaggtctttagctgtagcttttaaagaggctggatatgtactggtaacatcggttcctacgatttctttttcgtgtcccaaagcagctacgatctcggtaattcctccgttgagtgtcactattttattgttcgtttttggtgcttcagaactggtttctgttgtattttcttttgctcctgtttctgcttttttgcaggaatatactgcgacaagaacagaagctgcaaggatgaattttttcatgatatactattatttgattatttataaaggttcaaattcaaaattggtgtaccctctttctccttttgtatttttcatagtgttgaatctgagtttaaaataaaaaccttcagcatcttttaatacaaagaagcggtctgaatacacaaacggaaccggatttgttgctgttcccgtagtggttctccacttatctcctattgctctctggtcattgaatacaaattttgcaggttctacatcctttagtttaaatgcgctgtaagcggcatcaagacttcctgtgacatttacctgataagctcccacaccatttaaggtatttgttgtcacaaaatcagcataaaaataacttcctgcactgttgtttggtcccatgaatacctcattggtaaaggttgtgaacgcaaggtcccagttttttttcttaggctgaatttttaccggtgtacccgttttcaggctgaagaacgcaaagttgtactcagtatctttagtaatgatatattctttgatatctgcttctgctgcattcaagtcagcataacggattttgtatccgttctgagctctcaggatctgaattttcttccaccctctcgggtcgccggacaatgaaactgaacctgccccgatattggcggcagaaggtatctctctcccaagattgatcaggtaaacaggattatctgcatcattttctttgatggcatcaattcctgaagtctgagtcagaaaatttccatcaggattgtctacatattgcatgttggcagcatcaaaagttcctacctgagcaatgtctttcagacctgagatatcagcttcttttactttactgatgtctgaagcattggggactttaatcactgtcatagccagagatccgttcatgatcacacggaattcatccccagtataaaaaccaaggtcccaatctgttctgcggttaacggctgaactggtgtagtcacttaagtcaatccaaacctgattgggttctgtaggaccaccgatattcacacttacttccgatcctgtcattggaggaaccggaaccggatcttcgtctgcagagagacaagactgtgtggcagcgataatggaaagaacggacactatttttaaatacttcatcatagtaacttattatttaaaattgaaacattaatcgggcaaaatagcttctgccgtagtataaattaacaaaaccactcgctgctgtatgggctgaacctgccaccgcagtagagttcagtctcgttacatcaaatatatttttcactccggcagaaatttcaaaatgtttcttccagaaaggctgactcacgataaaatccatcatatggaagctatctacttttccaagccggaagccgcttactccatcggatacatacattctgtccggacctgtaaacttgtaataaagggcaaaattggtatctgtgcttttcagtttataggttgctgaagcccctgcctgtactaaatactggaaatctgtaggggaagaagatttcaaatcgttcatcgatacggatgttccgtttacagatccccttaaagagagggcaaactgatcttttctgaaatctacgttagctgagaataataaatttttataggtatcaagattcatgtatttgtaagtggaaggctcttttaccatcaccatttcaattctgtcccgtacatcaagatataatgcgtcaagtccataagcgatcttccagccattgtctgccgaaaagttctggttccagaagagtcctgcagagaatcctttttcaggatttaaatccggatttccctggacatcatgattaagattcacaaaataagtgtacagttcatcatatttcgggaaacggttggctgatcctataaccgcacggagatttgaattttcagaagttttatatcttgccgataaagagtaattgtactgattattgaaattttcgctcaaagaaagccttactcccggtctcagagagaatttgtctgaaacattccattctgcagaaaggaaattggaataagtaaatatttttctttttaccgcttctccaaagaaatctccagcgatcagtgcagcatatccattagtataatctaattcatatcccaactgaaaatcgaagactttgctattgaggaaattactgaacatccctcttgaataaacaacatctgtcttataataagatttttcatcctgacggctctttattgttctgttcggaatatcataattgtagtcataatattttctgtcctggttctgataagagaagtctcccaaatatcggatatgtcccaggttggtttgaatattaaactggtgaatccagcggtccgtgttgtatcttctgtctctgctttcataggaaactccgcctgctccgtcattcagaggatttctgctgacctccggattgtaaaagttgaatttttcattaagataagacagcttgtagaagaatgttgttttgtttttcgtgtatctgagtaatgctgatgcatcgtattggtctttcgggttccattcatatcctctctggttatcctgcccgaaatatttgtagcctttactttctccttcgtaccccataaactggttatggttgaaattgatactggcaaaccattcattactgatattataatctacattcaagttctggatatgtctgccgttaccctttttcttaagatcataatggtctcttatcgtttcttcctgcaatgaacctcttacacttattttttttgtaccggtctttttcgtaataatgttgatgaccccggcaacagcaccgtttccgtactcaacgcccatgcttccttttacaatttcaattctttctatattgcttaaggtaattttggtaaggtcaatattactgcccagtcctgtatcccccactaccggaatattgtctataagaatctttacatagtcaccgttaagtcccatgatattcgcggttgaatttccggagcggctatcaggagtgatctgtatgttaaggctttgattcaaaacctcggcaacgttcgtggctgccatatttttaatctgttctgcatctataacatcaaccttatatatcgatttgttaatggactgctgcatgtactgtcctgtaataacaacttcttcaattttcttttgataaagagaatccttttcttgtgcattcatccataaggctatggataacgttagaacggaaagcactttcttcttcataagggtacaaattttcgacaaatataaaacttttatttagactcattaaaaataaatatatatttttgtggaataattctaaataaaaataatctcatgaaattaaaattacttttcggaactctgatgtttacagccttaactgtgaatgcccaggtatccagcatcaatgaaaatttcaataatttcactgtcggaaataccactttcccacagtttggctggtctgccatcgttgcaccaatcaccggtgagtttcctcccgtacctccaagaatgattgtagcaggagattccaacagattcatccagtcatacgcaggaaacaacgctacgggctcttcctacctgatttcaccgcagattgaaactcccacaggaaataaaacactgacttttgatacgaccttggtatctccatctcctggccccggaagcatccagattggaatagcatctaatcccgcagatatgtcaacatttgttcctgtcggaaatcctattaatgtagcgacaatcggcactgtacagaatatcagcattaatattccggcaactacaggatcttacatcgtattcaagttcatgcctactgctacccatgtagccattcaggttgataatgtcatttataatacagcagcttcattaggcgtttccgacaacaatacaacaacagagaatttcagatttgctttaaatgctgatcaaagcgctttagaatttgtcatgaaaaaagatcctaagaacattcagatctattctgctacaggcatgaaagtagcagaaggaaagctaaacggaagaagatttgaaataaacactcttcagacaggtatttattatatgaatattgaaacagcagaaggaaaatttattcaatcaaaattcattaaaaaataaggttaatcagactattatttacctttttaaagccgacagaaacgatttctgccggcttttttatttatgattttttcatttttaatgatgatcacaaaatagaaacaagacaaaaatcatgtttttatttagactgattaaaaataattatataattttgtggaaccattctaaataaggatttaaaaaataatttatgaaaacaaaactattattggcttcggtactggcaatatctgttcagcagactgttttggcgcagactgacgcattgggatactcacaggtaaacatgactatgggaagcggatatcagaatcgcgtatttgtgaaccttgcggatggcaatatggtttcccagccagccaatacctgggatattgctttttacagaaattcaaattatgctttcggatcgagagtgaatgatgcaaaagatatcgaagtattcacagcatcaaccaatttagccgactgggacaatatcagcatcagcaatgaatcttcatggggagcccctttgtacaatccggatcagacaactgactggagccagggcgcttttgaacaaggcccggtgacctctcccaatcctaatattccttcaacaggctggggagtttacaatcctgtgaaccaccatattcagggaaaagcaatttttgttttaaaatatgcttcaggagtttatattaaattcgctattgaagatgcatttgccggatatacgttcagatattcaaaatggaacggtacatcttggggagctactgaaacaaggaccatcgccaatggtacagatgattcttatttcaattatttctccttcgataccggagaaaaagttccgaatctggaaccatccagaacggcatgggattttgtattcaccaaatattacactttctatatgggtgtacagatgtacccactatccggagctattcaaagtcctaatatcaaggttgcgatggtacagccggaaactcaggaaagtgcaggttatagcataccggccaatgctaatttctcgtcaacaattacaacggtgggacactcgtggaagggtatcggaacggtaaaaaatgatgttgtctactacgtcaaaaaaggaaatgactactacagaatgtacttcaccacgaatggtggagcaagtacaggtaacatgtatttcaaatacaagaagattactgaaacactaggcattaccgaagttgggaaaaaagcatctttcggtctgtatcctaaccctgcgacagctgataaaaaggtaactgttctttttgatgttaaagaaaaggcaaataacaaagggaatgtagaggtttatgatcttaccggcaaaaaggtctattctgtggaacttaccaatcaggctggtttctataagcaggacctgaacctttctacccttacttcaggaaattacctggtaaaaattacttacggaggccactcggagacgaaaaagcttatcgtaaaataatctttcaattttaatactttctattttttctaataaaaaggcggtttcagagtattgaagccgccttttattctttactgaaattgaggaagtctttaaattttaaatcttaaatccttcaatatcattaatatattttaaatcctttgtaaacttctgccgagctttccatgattttggatgcatctttacggaaatccaacaaatggtcctgcccattatgcctgttgtggtgctcaacactttcccaaagctcgatcaggaaaaaagttcctttattatctttatcttcaatcaggtcatactgcagacagccttcttcttttcttgtttctttcacaagcttctgaaacagctctacagcatccatcagataattttcattaaacttaaaaagtgcaatgatatgtaaattcatgttctaatatttagtgatgtaaaagtaaagtattttcaaaatcaaatatctttttacaccttttatttttccacaccgaacataatttttaattaaaaactgatttataaatagttatagaactcattacaatcaccaaagttccgataatcacaaacattttcttcacaggaagcttagccgtaagcatggcagaaaaaggagcggtaacaattcctccaatcaaaagtccaagaatgatattccagtgctggattcccagggtaaagaaaaaggtgacggctgcagtaatggtaagaataaacttggccacggtagaacttcctacggcaaatcttggagtaaatgcatttttgatcaatgttccggttaccaaaggcccccagcctcctcctgcaaaggaatctatgaagccgcctatcacacccagcctgatcaggttggtttttcttttcagggctttactttgtttttctttaaatgcatttgataaaatctgaaaaccgagatataaagtataaaaagcgatcaatgttttggtgatctttgcgtaatactctccaagataagtaagacatactgcaccaataattgccccgattacagccggaatggccagcttttttaccagactcttacttacatttttcaatttaatgtggctgacgcttccagcagcggttgtaaaactttctgccgaatgaatacttgcgcttacaatatgcggcggaatattcagaagcatcagtgttgtggtacagataaccccatatcccattcccattgatccggcaacaatttctgcaaagacccctaccagaagcatccagtaaaaaatataattattctttgcaagaatagtctgcagctcttccaggtatcccagttcatacattgaaaaaacaatgatggaaataacagcagctgttacaaaaagaacattaagccttacctgaatttttcttgaaatcaccatattataaaccgtttttgttcattactatttttatgatcattgtcaaagacattcaacggttatttgccattcctatttccaggtcggaattttttttcagatagaacatatgcggcagcccaatggactgcaatagcagaaggggtgatcttttgtgattggttttcttcttcttttgaaatcatagtttattcatttgaagtagtgcaaatatctgataaaatatctatcctacaaaacaagtagactattaattcaaaaaaaaggatcaggttaatcaaccagatccattaaagttttactttccagaatattcagggatgcatcccgaacctctatcagcacatcatgaagtccgcagtggtcttcattgcagtcttcacatttttcatagaaattcagacttacacagggaagcatggcaataggcccgtttaccaggcgaataattttagccagtttcacattttcaggattttctttgaagaagtatcctccaccctttccttttttactgtcaaggatatccgcttttttcagttcaagaaggatattttccaaaaactttaaaggaatctttttatgttccgcaatttcagaaataagaatcgggccttcatttcttttttctacaagatatgaaagcgccttaaacgcatattgagatttttttgaaagcattacagcaaaaataagaaaattgtttaatatttgaaaaagagagaaaagtgaaactgtaaatgcgtaaaagataattttttcatccgtaattttacggttttatataccacatttttgcctttctgccattaaatcattatgtttgccatatgttcagtaaacaagaggcacagcaattaaaaaaggaattttggacagctttcggaaagtcatttcccagaaaatggattctttatgataccaaaatcaaggacatggcatttaaattttcggccgacaataaaaaagcagaagtttctctggatatcgaaatgagagatgaaattttcagaaatgcctattatgaaaaaatctggtctctggaagatattttaaaagatttcgttggagattttcagaaggaagaatattttacccttgaaaatggcaaagtgatcagcaggatatgggttgagaagcatggcgtttccatttttaataaaaatacatggcaggaaatttttgaattctttgtagacaaaatggatggctttgaaaggttttactatgaatacgaggatttcataaaagatatatagaatacttacgaaataaacactattttatgcttcggattaagataaaaaaagaaaacttatctttgctacaccacttaaactaatagatgaaacaaaataacatgattaaaaatgagaaaagtgtacaaaaacatttttggagaggtcatttccaaaagtaaagctgtgaagctaaacgaatatcatctgtattattatgaagaaggtaccgatttcctgaaagaaattgaatttattaatgaagacagtgtttacaacatcaattattttttaagtgacgaagaagacgaaacccaggtagtggattatcttaaagaaaaatctgatttttttgatattgaaaaaaaagaaaccacggacagctttattatttctaccaataaattatattccttatctgtagacgacctccccttaatttctaaaactgttttcaaaaaagacgaccccgaaaactttatctgttcacaggtcattgataatgaaacccacgaaccgcaactcgaaagaactataaaatgctggtacaccaacgataaaaacggtgaaaaatatgcagcgatagaatgcagctatcaggaagacgggaaacttgagctggctgtagataaaactccggatcccgatcatgaagaaaactgggttcattatgattatgacactttccacgatcttcaggcacaaatacctactgatatcagctattacaaaacagccgccttacttcccaaagaggcatatcagcaataaactttttacacatcatctcatttttaaaattattaaatggaagagaatcctattttttttgcagacggaaatgatccgcaaatgattgaagcttacaaaaaagcacaggagacttttaagtatttctggcgtgaacaatcctgggaatacagaagaattattccggggcttaccgtatcatgcgttaaaactgcttttgaagagcaggatgaagaaaccggagaaagcctggtagaacatatgtggatcaatgaagtattttttgacggggatcatgtaagaggatatcttattaatgagcctaacaaccttaaaaatgtacaggttggcgattatgtcgacattcctttacaaaatatcacggactggctttttgccatcactccgagtgtacagaaacctaaaggactttccagactgttttcatcttcttcaaccccacttccaaaagcttacggaggttttaccattcagaaaatgcgtgctgatatgtccgatgtggaaagaaaagagcatgataatgcctggcagcttgatttcggagatttcaatgatatacttttggtgaataaccagaaagaaaaccctgaaaatctgattgaacatccgatgagtaaaaatatgagagaggaatttgcaaagttcttacaacagtatccggatgagcttacacaagctgatgaatacggcctgacacttcttcacaaggaaacaattgcaggcaatttaaccactgtgaaggttgctttggaagcaggagctgataaaaatatccgttctaaaaaagggaaaacagctctggattatgcaaaacagctaaactgggagcatcttattccggtattggaagggtaaaatattaattaagagtattataacccaaaatttgtttaaacttttatttttgaaacattaagattgtattaagttgttgagagtattaagataagcttcgctttaagcttaaaaatcagaatgattcatcttaactatactttatttcttaaatccttcttaatggtttttaatattcaacatttttataagtctaaacaaatactcaatactaagtttttaaaataaaaattccggaagaaaaatcttccggaatttttatttattcttatccaaacttcttctttcttaaccagaagaacaaccctccgagaaggcctataatagccagtggaagcagtaaattcagccactgccatgtagatttctcttcagtgattctttgtctgtcaagaagtctttcttcgatatttctgtttctcagttccatcagattgctgtcatccagcaggtaatccaaagcatttctcaggaactgttcgtttccgaattgttcgttcgtcaataaatctactcctaacggaagtggttttcctttgatcactttgtttcttcctacatctccgtctgcaataacgatcattttattttccggactggatgttttgaatcccgggtaagactttctttcaattcttgatgcatacgcagaattaaatttcccttccaatgctacagcgaagattttcggtgtacttggtttttccatttgtcccagactgtctacgcttgcaatttctttcagatccacataatttggaacctgtttcaacagtgttctttcactggattcaaaaagaacttttgttctgatattttttctgccacccaatgtatcaatggaagtcgggaattcgaattttacagggttaatatttttggtaattggattattattttcagctattccaagaggataataaggccatggaaggcttgtgtactgagggtttccacttacttctcctgtaaccagtcttaatagtgcaaatttcttaacgtcctttaccaaagccggattgattctcaccccgtaattgaaaaagaagtcggtcatattgatatcgatcgggaaaggcattacttttttggatcttgttaaggtatccatttcagcatttaccgcatcaatcatccaaagtgtttttcctccattcatgatgtactggtcaagaattactttttcattatctgtaaaagcttttctcggttttgcaattaccagggcgctcatctgtttcaataaaggaacatcttccagtgaaagctcagtctgatttttaggaataataggtcctgcatcatagttttccatcgccagctgcacaaatccctggaattcatccggattcaattcatcatggttgaccaaaatcccgattttcttttttttggctgctgcaatatttttaatattggaaacaagattatattccagtccttcaatagatcttgttagttgctcatcggcatcaattcctgcctgctgtaccactaaaggaatagaaacaccgtcattaccgtgtttgatcacagcgtaagggaaaagcgtgatctgtgagattttcccgtcttttacatccggaagaatagacggctgcattcccattgccataagggtatcctgagacattttggttttaatgggatcgataaatttaaaatcaatcttcggattaatttttctgaactcttccagcatgaacttcgtttcgctttgcaactgtttgaaacttgccggaaaatctccttccagatacacttcaacagtcaggggcttttttacagactctaatactttgatggtgttatcagaaagggtatatcttttttcttttgttaagtctaatctgattcctgaataggtcaggataataaccaaaggaacaactgcaattaagaaaattcccagtggagatttagcattgaacttcttcatacttctacttctttttgttaataaaatgattagccaatactaatgaagcgcagataacaagcacaaaatacgctacatccttagcatcaataagccctcttgtaaagcctaggaaatgctggtaaaagccaatattctgaagaatgaaatcagctccacccaatagtttataacttgccagctgctcaattccaaaatacataatgaagcacatgaaaacgcccagcagataagccataatctgattttgtgataatgaagacgccaggattcctactgctgaaaaagcagctattaagatcatcagtccaatataacttccaaaagtcattcccagatcaatatttcctgccggaactcccaaaacatagactgtataaaggtaaattaatgatggaattagacataaaattcccacaatccacacagaaagaaatttgcctgtcaccagttctgaaacttttaacggttgcgaaaaaagccagttcaatgttccggtttgctgttcttccgcaaaagtcttcatggaaagggccgggatgataaacatcaacagccatggtaccaatacgaaatagctctgcagtgaggccattccaatctcaaaaatattagaatcgttgtcgaaaaagaacaggaaaagggttgctatcaggctgaaagcggcaatgatcacccatgcgctccagtttccaaagtaactccaaagttctttctttaaaattgcaatcatagttttttgtaagatataaaaaggatgaatgttttcaaacatacgtcctgctccacaattatttgttttttttgtttttgttaaccagttttaccgtcatcatgatcagcaatacaagaacgaaaaatcctgtaattaattgccaccagtattcaatcaccatggattttagaataaccgtaaataccaccagaaacagaatgaaggttgctatttcattcgcctgtctcagcttgatgttggcaatgggtagtgtacctccatgcagatcctttaaatgaaggacttttttccagcaccagtaatggtaaatggcaagtccgataaggaaggtcagtttcaaatgaaaccacggcattttcatcagcccggtatttaaaaagatcatgaccaatccgcaaactgccataattactcctgcaggaacggtgataatattccacagccttctggccataaaagtatactgctctctcagaattttctttttttcttccggaaaatcatcagtgtccttatagtaaacgaaaatcctcacgagataaaaaattcccgcaaagtagcttaccataaaaataatgtgcagcgctttgattattgtataaagcattttaataaataaatttattgatagaaataattttacaatcctggtccaaactcttcagtacatcaaaaaaaatctttttcatatcctttacattattataataagaatatcccataaaaatagccagccccaaagagatcaatataattccatacgtggttccagaattttcatccgtataaaaaggaacaaaaatccctaaaagaagaacaagaatgagtacatcaaaatatttaactccaatagatactttaagaaactcttcattatttttgtctgaaacaaattttcctataaaagacaaatattcattccccatcacttttacttcaaatccatcatcagttacttcacctttaaactttttgccattataatcaggaaagctcttaaatatactttcttcaatcttagatagtatcgatttttttggcttcgaaaagacaacctgatattcggactttaaaaacatttcaatttaatcaggcacaaagataagtttttatctaattcttaaaaataaatttcttttgatcaggaaaacccaatcaaaaacggatttctataaaaaatagttcggctcggggcagcgaagctgcccgagccgaaccttatatttttattattgtatccaattcagcgattaagagatcactcctaattcttttcctactttttcaaatgcagcaatcgccttatccaggtgctcttttgtatgagctgcagataattgaactctgattcttgcttttcctttcggtactacaggatagaagaatccgatcacatagattccttcatccataagcttttcggccattttttgagaaagcggcgcatcgtaaagcattaccggaacaatagcagcatcgccttcagggatatcaaaaccttttgctttcatttccgttctgaagtattctgcattttccattactttatcacgaagagaagtatcatcagaaatcatatccagtactctcaatgcagctcctacgattccgggtgccaaagagtttgagaataaataaggtcttgaacgctgtctcagcatatcaatgatttcttttttaccggaagtaaatccacctaaagctcctcctaacgcttttcctaatgtagaagtaatgatatctactctacccattacgtcatttgcttcgtgggtaccacggccggtttttccgatgaagcctgttgcgtgagaatcatctaccatcaccaaagcatcatatttgtctgcaaggtcacaaactccttttaagtctgcaacaataccatccattgaaaatactccgtctgttacgataattttaaaacggtggttcttttcagaagcagcaatcagctgagcttccagatcctccatattattgtttttgtatctgtatctagccgctttacaaagacggacaccatcgatgattgatgcatgattcagttcatctgaaataatagcatcttcttccgtaaacaagggttcaaaaacacctccgttagcatcaaatgcagcggcgtaaagaatagtatcttcaagaccaaggaaatctgcgatttttttctcaagctccttgtgaatatcctgtgttccgcagatgaaacgtacagaagacattccgtatccgtgagattgaatcatatcctgagaagctttcatcacctccggatgattggataatcccagataattattggcacagaagttcaaaagcttttttccgttagcctctatttctgcactctgttgagaagttatgattctttctcttttgtaaagtccgtcattctcaatattctgaagttcattctgtaaatgttgaaggtatttttcagagatcatttttagtaattttttagatgtgctaatttactaaaaaggcagtaaaataaaaccttttataagcttaattctaaaaaatcagttcaggtttaagttttaacattattagtctactaatttagtaggataatatttatatttgcttaaattttgaatatatgagattaaagccggtacaaaaaataaagacaatcagctcagatacctttattaataaccatatgaagccgagaattccaattattattgaagatttcgtacaccctgaaagccaagctttcaaaaagtggaattatgagtatttcaaagaaattgccggagatcagatggtcaatgtatatggtagtgagcttgattccctggacagagtcgcaagtgatcctattgcccagactacattctcagaatatctggatctgattcaatcaactcctactgaacaccggctcttcttatttaatttactgaaaataaaacccgaacttaaaaatgatattatttacaatgatgtaacaaatggtaaaatactgaaatggctgccatttatgtttttcggcggtgagggttccgtaaccagaaaccatattgacattgatatgtcccatgtttttatcacccaattccggggaatcaaacgaatctggctcttcccctgggaacaatctgattttatgtataagctgccatacaattttcacagcctggttcagattaaaaacccggattacagaaaataccctgctttactctatttaaatggctatgaagcagtcattcatccgggagacacgctgtatataccttcgggatggtggcattatattcagtacgatacagaagggtattccatatcggtaagagcactgccttcgagtcctcttgaaaaatggcgcggttttaaaaaccttgtcatcaccagacattttgataacctcatgcgtaagatattcaaagaaaaatggttttcctacaaggtcaggctggcgagacaaagaggagccagagcagcaagaaaacaaagaagctttcaaatctgaaagcttcttctgtattctatttttaaaatcccgaaaagtaatccttcatactttccaagcctttattttagtgcttaataaatttaatattcttttcatcaatcgtaataaaataagctcccggaaccaattctgcaattccaattgctttacctggctgatacgttccttttccaaccagctttccgtcaattgcgtgaatcgtaaagtccacagctctattgatgcctttcagattaatttcatttttcgcaggattcggatataagccaaagtcttccttctcaacagaagaaacgctcaatgtattatcctgggtaaccgtagagtttttctcaattatctgatactcgtaattaaactgaacacttgctatcgggaaggttaccgattgaaggaaatattgattattagaggtattgttaagaaccagataagctgtctgcccggatgttcctgtcactttaatcggcaaaggcatttcgaaaaagcttaccgtagagctgctctgtgtctgtgaaactttaaataaagcctgatttccgctctgcatccactttatggtataggtaggatatccttctccatacacccaatcattaaaaaactctgtaaaatctgtccctgttgactgcagtaaagaggcattaaaatcagctgtacgtgcatagctgtaagcaagattcggtcttgcatgatagtctttcagtgcctgataaaacacagtatcccctaaaatccatttcagcattctcagcacatatcctcctttggcataagtaagtctgctgtcaaatattctgttgatgctggaaagtccgctatccggtacatatacgcttccggttgtgcccgctgtaatataattggactggccttgtaagtaattcagaaaatctgtattgttcatcaatagtttttcattggcaacatgttctccgaatgtggcaaaaccttcattcagccagatatcattccatgcaccgcaggttaccttatcaccaaaccactggtgagtaagctcatgagcaataagctgcttgctccatccgcccatagaagacatagtttgatgctccattcctcctccgtacataaattccatgtgtccgtatttttcattccggaaaggataagaaccaaaataagtttcaaaggtatccatcacctgctttgtccagttaatattagctacactggttgcattggagttcgtggacggataaatataattcacaaaaggaaaaggaggatttccgatggtatcagtaagctttacaaaatttgtaatcgaaagagcaatcaggtaggccggcgtaggatacattgttctccagaaggtcagtttggtatttcctgtaggaaaagtttcagacatcagctttccattcgctgctacgctgtagttcgacggagtcgtaattttaaaatcaaacctttcaattttatcatttaaactctgcttggtaggaaaccaatcctgtgcaccataaggttcatttaaggtagaaagcaccggagttccgctttgaagagccgttttgaaagcatcattacttgtggatggtgctcctgcataatagatggtaagagaatccagtgtattggcagggatagaggccggaaaatcaattttcaattctttcgaaggaagctgttgaaagcttgtaatgttggttccatgatatttcacctgggaaaccgttaatgaattggaaagatcaaaataaatacttcccatagtctgtgtaggcttaaaatgtgaagtaaccgatcctgaaatattatacaccgcaggatccaggctgacatccattctctggtattgtaagtcgtaattcagggtgttgggattgatattccctatattcattttttgggtgaaggattttttctctttttcgattaatcctttcatatccgtattttgcctttgcttctggccataaaattgttgagacaataaaaatcccaacaccaaaaggtacaattttgtcatgttttgaaaaatttaatcaaatataaaaaaaaccttttaatcaatgattaaaaggctgttataatatataaaataaaaaatttctaaagatctaatgcaggttcaagaattttctccattcttttcttcaccatatctaccgatccggaatagttattcaccatcaaagagaaaaccagtgtttttccggagtttgttttcagatatcctgccagcgtttttactttattcaacgttcctgtcttcgcaaaaatctgtccgtttccgccagcattaaacattctttttaaagttccggattgtcccccgacaggtaaagaagtcagataagatctgtaataattctgatccatcagagaagtaaggaatttcacctgggaaataggagtaacattattgcttcttgaaagtccgcttccgtcgatataatttaaaccattcatatcgaaacctgattctctaaggtgattggtcactacaattcttcctgattctgaagtctggtctcccattttctgatatcctaccgttcttagcaaagcttctgctaaagaattgtcactgtgctgattggtataataaataatatcacttaacgttggggatttataggcagaaagcatttttctgttttccggagctgcatctgtcattttcggcgttacttttccggtaacaggaatgccgctttttaccagtgtggttctgaaagagttggcaagataagccggagcatcaggaagtttggtagttaaaactccgttgccttcgtatttatcagcatataccatctgatgattgtaaggggaaacgtagaaaaatttcttttctgtggagaaaccactttttttaacaatcagtttttcgttggccgggttgatatcgcgggtacttcctgcaggtaaataatagttattgttttccaaccatacaacattttccggaagcattgaaatattgcctttgaaaagcgctgtctgaatgataatatcaccatttacctttttgattccctctcttgaaacgccgcttacgaaatccgaaatgatatctctgtaagatgccgctcctgctttgtttgttcccaaagaagggtcaccgcttcctatgacataaagatttccatttaaaactccattttcatctacggttcctgaatattccagctgagtcatccaacggtagttttcgcccagcatattcagagccgtttccgttgtcagtaattttgtggtagaagcaggtactaaaggagtattttcattgtacgaagagatcactttcttcgttttcgggtcatacactacgaatccccaggttgcatttttcagcacaggatccgccatcattgtgttcacattaatgtctaccagttcttttgctgacaaaacagttttttccaccaccgtgctaacgggtgaaggtaggtttaagctgcttttttgattgtcataattctgagaataaagaacggtagaaacggtagattgagccaggaaaaaaccagaagccaacaccgctgcacttgaaatatattttctgaaatttaccatctatctttttttgttctatagctttgactcaataaaaaatgacaggttaaatcattcattaaaagaaccaaacacttaatcaacgtccaaaagtagaaattattgtcatataacggaccacagccacattataaaagagtgtaaagtttgttaaaaattgttaaaaatccacaaaaacatcttttttaatgctttgatatgcagtgatttcatcaaattctttcaaacttattaaaaccatgcttttgaatttttcatagttcttcccacggggaagcttaagcataatctggaactggtacaaattattcaactttgcaatctgagctctttcagggcctaaaacgcagtcttccggaaggtattttctgagaatagagcccagaaactgagaagcgcggtctgctttatcctctcttctgtgtttcagctcaatcatgatcagcttggtaaaaggcggataatgaaatttctgtcgctctgtcagaatatatttatagattttcgcagggttattcatcttgatcagctgaaatacagaatgatcaggattaaaagtctgaataagaatttttccttttccggaaaccctaccggctcttcctgacacctgcgtgatcagctgataggctctttcttccgccctgaaatcctgtacatataacagagaatccgctttaggaatcgcaacgagttcaatatgatcaaaatccaatcctttggaaatcatctgtgttccgacaatgatatctgtttctccgtcttcaatcttttcatacagcttttcgtaagcaaattttttacgcatagaatccacatccattctatccacctcattttccggaaacagtttggaaacttcttcgtgaatctgctctacacctactcctctttcgtttagcttttcagaattacatttaggacaggtctttggttttgaagctctttgtccgcagtaatgacatttcatctcattggccgctttatgatacgtcatcaccacatcacaattggagcagtaattcacataaccgcagctttcacattcaattacattggaatagccacggcgattatgcaggacaatagcctgtttttttgcatctaccgttttcttaatatcctcaataagcttcagagagaaattacctgaaactttcttagattcctgcgcttccttgaaattgatcagctcatattccggcagattaacgtttccgaatctttcattcagaaaaacgtatttcattttatcttttctggcgctgtagtagctttcaacagaaggtgtggcagatcccaggatgactcctgccttataaagtctccccaaaaccaatgaggcgtccttagcattaaaataaggagatacttcccttggtctgtaagcagaatcatgttcttcatccacaacaataagtcccaggttctggtaaggtaaaaacagagcgttacgggttccgatcagaatacggatatcgttctgcttaattcttctccatacttccaccctttcaaaatcagtaagtttctgatgataaaaacctaattgcctgccgtatttcttttctaaccgctgggtaatctgtttggtcagggaaatttccggaagcaaaaacagaacattttttccttctttaatacattcatcaattttctctaaataaatatgagtctttcctgatgaagtaacaccgtgaagcagcacattctttccttcctcaaaagcttcatcgatctcggatttggctgttttctgctgttctgaaagttcctccagctcttcaatttctccttcatagctttcgatcctgtctttctgcatataatattcctccacaagacctttgtctgctaaaggtttgaagtgcgagctaccgaaatagccatcttcaaacagttcagatttctttataggcgtatccggattttcggtttgtttttccagaataagaaggaaaagatctttttgcttttgcgccctgttcagctttaaaagaatttctgtaaggttctgattggccagcacctcatcattaatccttacatacgctacttctttagctttatatttttcagcaatcttctcatcaatttcaatatactgaagatcgataagcgaattgatggttctgatgatatcttttttaggaataaatgcttcaatatccgtcaggttgatcagctggcgcacctcaagtgcctgaatcaggtacatttcgttgacatccagattttcaaaatcaacaattgcacctgcttttaattttaaataggtttcactttcaagttttaaagaagaaggaaatgaaaacctgtaaatttccccaagattgcacagatagtattctgaaagccagttccagaaatcaatctgttcctgaggcagaataggttgatcatccagtatgctgatgatttccttggcaacaaaattttccggtgcatgatcatgaagctcaaatacaattcctgtatagattttcttcccgccaaacggcaccaggacacgcattccgggctggatttcggacatcatctcttcaggaactttataggtgaaagatccttttaaattcaatggtaaaactatctgagcgtactgcaagggaaatatttaaaatgtaaaattagatttttcctgagagaactgcaagtttgcggaaattctttcataatcttaacacaaccgtaagcaaaagcagttataggtgttttgctgcctcatttgtccattccgtaggaatctaaacaatcagatagtatacaatctaaaattgtcttaatttatttcaaaacaatgatatgacaggctggattcctgcggaatgacaaagcgtgtggataaaagaacaacacaaattcagaaaggatcgaagaaaggattcatgaatgactaaaaaagcagttccgtgatctgataccagaatgcagaagtaaaaaagcctacaataatactgaacccgatgatcagattggtgagttttgtattcagcctgaactgttctgcgataatacttgaggtgaccaacgtgggcattgctgcttcaaataccgtaatttttgctacatttccttttattcccaataataaagccattcccaagacaattgcgggtgcaagaataagcttgtaaagcatagacatggacatctgcgggaccagttttttccatccgttaaatttcagctgcaacccgactgaaaacaaggctaaaggacttaccgttgctgccagcttatcaaagaaaggttctgcaacagtaaagtcaataaactgcgacaaaaccaaagcagaaatacaacctattaatggcggaaatgtgatgagtctttttaaaataaataccgcacttacctttccggatttgcttcctccttttactgctgcaataattcccagcgtagaaagggcaaagaacatggtctggtcacagataattgcaatactcagaagcccttcaccataaaaagcactgatcagcggaaatcctatgaatgaagtattgctgtaaccacttgccagttccaaagtgcttctggagcgccttgaatagcctctgctcttgctgtaaaacatcataaagaaaaagcagaacacagcaattaaaaatgtggctgcaataggaaacagcatttctgttgtccattttactttaggcaggtatttaaaagaaactgccggaagagcaagataaagaatccaggtattgatacccttatgagcatcggggtggatagattttgttgctttgaatatcattcctgcaataatgcataccgcaatcagaacaaaatttaccataactgtaataaaatatggaacaaatttacggctgatttttcagttggaaaggtaaaatttatatttttttgagttaaatttctgatgaccttttaaaccttatagattttaaaaacctataaggttagagagcttttactgaattttaatctttcatcacattccacaggctcatcacctcaactttttccaaaggttttgaaagggtaattctttttgaagttccaggcaggagatcaaagaaattatcgctgaaatgagtatcaccgatcaggtaaatatctttggctaaaacatctgtagagatttcaatctgagtaggtgatatttttctgatcttaatctcaggttttaaaagttttaaatctttcggtttatcaaaatagaaaagcttttcaaattttgtatctttttcagagctgatctttaaaacagctccggacaaatcaaactgagccagctctgatttgctgatgtttcggattttcttactaatatcagcattgatgacatctggctgattggctttccaaagtgttttccctctaaaattaatgagttcaaacgtgatatctgttgttaattctttcagcagatcactgatcagataaatatcataatctttttctgtttccgttattgagatcaaaacaggttcaaagcttcttttcgcctgataatggaaagctttccagtttcctaaataatcaatagaagaccatgaaactaccggccaacagtcgttgagctgccaatacaacgttcccatattatagggttttgcacggcggtgagcttcaatggcaatctgcattcctcttgcctgcagcagctgtgaaacataattatactgaacaaaatctgacggaactttgtaatcacgcttcagatattcattaatgatatcccagcctctggcgtgcttttcatgcgctttgatcgttggattctgaaggtttaaatcaggaattccggaaaacattgattttgtagtttcaagagtaggagttccctgaaaaccatattcagacatgaagcgacctactttttcgttgtaaatctcaaacggctgctcaccccaccatacaccccagtaatgagaatctccttctgtaagactttctttatgcccccagccgatagacggagaactcggccagtagatatttttatctgacttcaggttttccgccaatgccttgggaatgacatcgtgaaacaattttttatagtctttccaaacctggagagagtcattttttgaatatttgaactgcttctggtatccccagttgacaatggcttcatcaatttcgttattcccgcaccacaaagcaatggacggatgattctgaagtctggtgacctgatcttttacttcttcttttacgttgtttaaaaaggcttcatccgccggataaaagcttcctgcaaacataaaatcctgccagaccaggattccgttttcatcgcaggctttataaaattcatcgtcttcataaataccgccaccccatatacgaatcatattcatattggcgtctttggtgtctttgatcagtttctgatatttttctctggtcattctaggtgaaaaactatctccaggaatccagttagttcctttgatatacaatggctctccattcactttaaagtaaaatgactttcctttttcatctttttcctgaaccaattccacggttcttaaacctatcctgatatttttaacatcaatatttttctgatctttggaaagctttactttgaaatcatagagattagcttcaccacgtccatttggctgccaaagcttcatcccgtcagtatcataaggaaccgaaatagtattaattcctttttttaaagatattttttggtggattttattaagatctaaagtgtaatttccagcgttttgagcataaatctccacgtcaaatcgtaaatcattaacctctttagcagttctgttctggatatccttaactgaaataattttagcattattccagaattccagttgaacgtctttccagattcctgcagtaaccagccttgggccccagtcccacccgaactgatattgagcttttctaacaaaacttcttggtgattcgggcatggtaaacggaacttgttttgcaagttcttttccggtatttaccgcagaggtaaacctgatctgtaatgtattgttacctgctttcagatattgtttcaccgggatattccatttcctgaacatattatctgtcttcttcagcagcttaccattaagataaatttcagaaaaggtatccagtccgttaaagaccagatcaatattatcattcattaattcccgggaagaaaccgtaaatgctgtttgataatcccagttttcattttctatccactgtactttcttttcattttcatctttatacggatccggaatcatcttgttattcatcaaatccagatgaactgttcccggaactttcgcaggaagccagctttgttcttttgagtttttgaactgccagttctccgaagacaggcttctttgtgaaaactgtgcatgaagaatattctgcatgaaaaagaaagcaaaaaggatagttttattcattaataaatttgttttgaatcgttatcataccggtgattttgtcattccgaggaacgaaggaatctctattttatcagtctagattcccactacgcctggaatgacaaccagagtacgtattatttattcttcaatgcaatcacctcatccgggctggcaaatgctccaccatcagtaatggctgaagaatgaaagtaaccggcattggtcaccgctcttatttcttcaatattggatgaacggagtccacctccaacgagtatttctatccttccgttggacaattcaaccagtttcttcagattctcttttccttcagatacattgggtttctgaccggaagtaaggatggttttaaaaccgcattgaattactttctctaaagactcttccaaacctgcggcacgatcaaaagcacggtgaaaagtacatggaagcggtgaggccaactctaccaaaactttattctgttccatattgacctcatcattttcattcaggataccaaatacaaaaccgtctgcacgcaaggatttcaggtgtatcaaatcatttttcatctgttcaaattctgaatcagaatacgtaaaatctccacctctcggacggatcatcacaaaaatcgggattgtaattttttcacgaagctttttcatcgttccgaaatccggagtagttccgccttcactgagtccatcacataattctattctgtctgctccattttcaaaagcaatgactgctgattcaggattaaaacaagctatttctatttttgacattgtattgtatctatttaattttatttcggttcgtcctgccatacatctgcaatcagaaaggaaccgttttcttttactacttttactactgacgggtattctgctttaaaatttttgtctgtcagcactacattgaagagatattcatcttttgaagagagttctaaatcacagcttccaacttcaattttatcccagtcctgtgctgcaatcaggaagcccgttccaacacctgctttgcttatatcaaatttggatttccacttatcctgaaattctttttctgtgagacctccatctacatccaggtcaacattcatcgcatccgttttatactcaaaatactctttggttgtgatcttcctcatattcttttcttcacttccgacatcagctttaaagtaatcgacaatactactttccagccatttcttagcatcttccgcctcattggtttcattattcagaaccactttttcttctatctgctgcggtttggcctctgttttaatctccttcttttcttccttgcaagcaataatgagaagtaaggaagcgataatcgttcttttcatatgtatgttttggctaaagccaatagatgttttattgatttttaaaacgggctaaagcccattcctattgaatttttaattattttaaagcaaattcaggtttttcaaggcggtttcctttctggtcatataccgcaaagttgaatccgtcctggatacaatacgaaccatattccccttgtttattgatcgcgataaaacctacctgaatgtctttcagatttttgtttcttcgctgattgatttttacaattctgtctacagcttccttacaagcttcctgtggatttctgccttgtctcatcagttcaaccacaagatgggttcctacggttcttatcacctcttccccatgaccggttgctgtagccgctcctacctcattatctacaaacagacctgctccgataatcggggaatctcccactctgccatgcattttaaaagccattccgctggttgtgcaggctcctgaaaggtttccctgggcatccaaggcgatcattccgatagtatcgtgattttcaatattggcgataggtttgtactggctggtttttagccattctttccattctttttctgattcgggagtgagaagattttcttttttaaaaccctgcgaaagggcaaactgcaaagctccgtcccctaccagcatcacgtggggtgttttttccattaccgctctggctactgaaataggatttttgacatgctcaagacatgcaacagagccaatattatagttttcgtccatgatacaggcatccagcgttactcttccatctctgtccggacgacctccatatcccacacttctttctttggggtccaattctacaatacgaactcctttttcaaccgcatccagcgcttttcctccttttccaaggatggtccaagcttcttcattggctttcagcccgaagttccaggtagaaagaacaattggtttgttaacagccgttacagcttgttcaggtaattcagcagccatcagatccagtggatttacggcaaatgcagctgttgccattcccagttttttaataaaacttcttcggttattgttcatggtatctcaaattgtataatatccacaaatctaaaaaaaagttctatgaaatcctcatgacactcgtatgaatatccttgtattattttatttatctttactgctgtaatggactcatttaaaattttcaggaatatctctttctttcaggaactctctgatgaggaaattgccattctggtcagtatcagcactccgaaacttcttaaaagaagggaaaaactggcagaacccggcaaacatttcaatcatttatttattctttccaacggattagtaagatttttctttgatgatgaaaacggggttgaaagtactctttttttaccttcggaaaaggaagctgttattatggaaagtccggagtcttacgctaatgaaaatgagaggaaatatactatagaagctgtattggaaagtcagattttcctgttcaataagaatgaatttgaggaacttgcatttcagcacagaggaatttacaatgtatacttaaagtctttaaaacagattatcagcatattaaaaatacgtacggaacaattttgctccacctctcctcattccaggtatgaagagtttctggagacacgtccctttacctcacaaaatgccaacagaaagtatattgctaatttcctgggcatcactccgaactcactttctaggatgacagcacgcatccataaaaaaaggaacgaaagaaaaaaataacttaggaatactttttctcactttattcactctatttttgcttactgaaaatactgttacacaaacaattaaaagcaaaatgagaaaaatacgatctgaaaaaacatcttattattgaaattacctttaatctttcttaagattcacagtaatcaggcatataaatattgacagccggattacgaccttgtttacatttcattattaccttatacaattattttatgcaaagaacattcttacttctttgcctgttactttcatgcaattttgttcaggcatcaacaggcaatatggaagacaatatagctaatgctgcatcatggttaatcttattggttttacccattgcaggaatctatcttttctggaaagttcatatttatccggaaaaagtagcagaaaaaaagaagcatcctcagctgaacgccataaaaagtatgtgcctcctttcccttgtttttggaggccttttatggccggttgctttaatctgggccaactatgattatggaaatcagaacacttcagaaaaagacacagaaatcacggaagaagaatttaaaaccctcgaaaattaagaaatatgctggaattactagtcgcaatatatgccggaatatgctggctgcttattaaaaaattaaaactgatcccctggacatttaccacacaggtcattgtgtactctttacccatttttggatctgttgctttaatattgagtttaaattattactgtcccatcacatctgacgtaaaggtaggaaaccgaagtgtggatattactacgcaggttttaggaaaggtgaaaaaagtatatgtaacgaccaatcaggaagtaaagaaaggagatactttatttgtactggacagagaaccttatgtacaggaaattaaatctctggaagccaaactaagtaatatgaaagccactgtaagctcttataatacggatatttcagcttcaagaaaaaacattgccggattacagtctcagctggatcttgccaataaaagggcggctcagtacaaagaactggtggaagccggagctgccaataagtttgatcttgagcaggcactcaccaatgtacaggatctgcaggccagaataagtgctgcacaggcccagcagcagtctttggaaactaaatcgaatgcttcttatggtggagaaaattcatcagtttctgagattcaggcaaagctggatcaggccaagtggaatctttcccaaacggttgttctggcacctaccgatggcgtaattcccaatgttcagcttaatgaaggagcaatcatggcaccttttaaatctgcttttgtcctgatccagaaacagcagtctgtgattggattttttgcacagaacgagctggaaacggtaaaaaacggtaatgaagtggaactggctcttaaaacagaaccgggaaaagtagtgaaagcccgacttgaatatgtaattgatgctaccagccagggaattatgaataacgccggaggaatgctcggaggaaacggttctacagcaggacttcctgatactgccagacagttaccggaaaccgacggaaaacttattgccaagtttgtactggaagacaatcagaaacagcttactgtgggagcaagaggaacagctgtaatttattctgatcatatcaaaccgcttcatcttatccgaaaagtaatggttcgtgtaagcagtaaaatcaattatctgatccctaaacttcattaacatgtacaagaaattaattttactgggcattctttccggaagtttaagctcatgtatcggttataaagagccaacaaaagaaagcatcacccagcttaaggaaacaagtgaaattgcttctcatgtagaaattccggatgagtggatctttgacagacaagctaactccagatctgtttcctatgactggatcaatgatcttaaaacccctcagctggaaaatcttattaatgaaggaatgctttataatgctgatcttattattgcgaaggaaaaactgaatcagattgagctggccatggaaattgcaggaagtgatctttatccgagtgtaagtgcagtagccaatacttccaataatctggtaagtgatacccagatccgtcgtcttgcattgaaagccaattgggaaattgacctctggggtaaaaataaatcttcacagatggcagcaagcagcaattatttttctgcaaaatatcagaataccctgcttcatcagtctattgcagggatgattgctaaagcttatttcctgaatattgcaggaaatattcaggaaaacaagattgagaattatattcagaagtctaaagatctggaaaagctgtatgttattcaaaagaagatcggaacagcaaatgctttggatatttccaacatctctgcagaaattatttctctgcagggctatcttgaaaaagtgaaaaatgcaaatgtacaatcaagaagatcattggagttgctcacaggaaaatatccggaaggaaaactggcaacacagaattacttcaatgctgtaaattcctctgttcctgaatcctttcctcttcagcttctggagaacagatcagacatacaggcgaatcattttcagattgaaaaagctttttacgaagtacaacaggctaaagcagcaagacttccatcattaagtataagcgcttccttcggaactgccggaagtaatgtggaatccatcaattctctgttttcaaatcctttattaaaagtgggtggcggattagtttctccgttattcaacaatggaaagttgaaaaagaatgtggagataaaaacctcccggcaaaaacagattgttgaagaatattcaaaagccgtcctgaacgctctgaacgaagtagaatcttctttaaccaatctccgttctatagaaaagcagatcacttacactaccagcgctgtcaatgaactgaaaaacaatatcagtctgactgagaaacaaataaaagtaggaacgaacaacagttttgtactgatccgtaaacaaagggatcttctgaaaaatgaaatgaacctcatcaatctggaacttcagtacagaatagagcgcattaatctttatatggctttaggggctgagaacttcatttattcataattttatacttaaaaagactgcgggttattgtcagcagtcttttttatgattgaggttgtttaaacttttatattaatgcggtaatttatccctgaaatatccatacacccatgttccggcaatggcactcagcaaagtaacggatactgctaaagctcccgttccgatctgcgcgaacagaggtccggggcaggctccggtaatagcccagccgaaaccaaagatcaacccaccgtagatctggcctttattaaactttttaggggcaattctgatgggctcgccatatattgtttttatattgaactttttaatcaacgctactgaaatgattcctaccaatacggcacttccgatgattccgtacatatggaaagactgcagacggaacatttcctgtatcctgaaccagctgattacttccgctttcacaaagataatcccaaaaataatccctgctgcaagatacttcaggttgtgataccatggatggataagaatgctttcgtttacacaaacagtgtcctggtgacgcatgttctgttctttttctttttcttttatcatgatataaatttctcttttaaaaattagacttacaaagaaagaatgacaggcagaataagattagccatcaaaaatcctccgatcataaaacatattgtcgctaccaaagaaggccactgcaggttggaaagccccataatggcatgtccgctggtgcatcctcctgcatatcttgttccgaaacctaccaaaaatccaccaacaaccatgatgataaagcctctgagtgtcagcagactttcaaaattcataagctgttcaggaaccatattgctgtaatctgtaattccgtagccggccaattctgctttcagttcgggatttactgttatttcattgggattaacaaaaaaatgggcagcaatcatccctccgaagaagattccaagtacaaaaaacagattccaggcttcttttttccagttatatttgaaaaaatttacattggccggaatgcaggctgcacagatatgccttaacgaagagctaattccaaaggatttattgcccataatcaataaagcgggtacagtaaggccaattaacggaccggcaatataccacggccacggttcttttatcatttccaacatttcttattttttaatctaatgtatttaaaattttagtctgacacacaaaatcacttttaggaatacctgtggaagcaatcgctttaaaacctccttcaacttcagtaaagtttctgaatccccttgcctgaagaatgcttgctgccattgtacttctgtagccgcttccgcaatgcatatagaaatgttctgccggctctatctcacgaatccactcattgatatatgccagaggcttactgtaagcttcatgaatatgttctgcattgtattcattttctcttcttatatcgatgatctttgcttcttttcctttgatttcggtttcaaactgctctgccgaaatacggttgacaaagtcagtttcctttccgctttttttccagctttcaaaacctccatccagaaaacctaaaatatgatcaaatcctactctgctcaaccgcgttaccgcttcttcttcagctcctttttcagctaccagcagaatgggcaggtttacatctgcaattaatgcacctacccaaggagcaaaatcaccatccagtcctatattgacagactgtgggataaagcctctggcaaaatcatggttagttcttacgtctaaaatcaaagcccctgaagcttcagcaatttcctcaaactgttccggaaccagagcatgcaaaccttgcgaaagaactttatcaaaactgctgtatccttttttgttcatcatgacattcatcccgaaataagccggtggaggtaaaagtccgtccgtaacttctttaataaagctctcccggtctttctgatttaaagcataattggttcttttttggtttcccaatgtatctactgtttctttctgcatgtttttaccacaggcagaacctgcgccatgagccggataaacggtaatctcatcttgtaaaggtaaaatcttgttatagagactatcatataaaagcccagccagctcttcctgtgtcatatttgctcctttctgtgccagatccggacgtccaacatccccgaggaataaggtatcaccactgaaaagtgctttctcagctccattttcatcaatcagcagatagcatgtactttcaagggtgtgtccaggcgtgtgaagaaccttaattttgatgtccccgatttcaaatatctgttcatcttctgcaataatagcctcaaaatcaggattggcagtcggtccatagacaattggggcacctgttttatggcttaaatcaagatgtccgctgacgaaatctgcgtgaaaatgggtttcaaaaatatatttcaattctacttcatcttctttcagtctgttgatataaggctgagtttctcttaaaggatcaataatagcagcttctccggctgaggtgatataataagctccctgtgccaggcaacctgtataaatctgttctattttcattgtatttattttttgattttgttatctggtacaaatctcctgctttcttttttcctccacagctacttttgttacataagaggattaaagaaaaatttctctggtaataatataaatacccattatcaggataaaccagccgaatgccggtttcagttttttaccgtcaatcttttttgataattgagaacctacgactattcctgctatggcaatgactgtaatcgaaatcaacagtttccaatctattttcatatgattgacagaagaaaagaatccaatcaaagaattcagggagataatgaccagagaagttcctatcgcaattttcatagggattttcagcagattgaccagtgcaggaatgatcataaatcctcctccagctcccaccaaccctgttaaaacacctactattgagccctgtcctgctgcctggaaaacattattcttatcggttttatgttctgaagtattttttcttatcattttataagaagcaagaatcattaacccggcaaaaaccagcagtaaaaaaatgtttctggtcatggtaaagttctgtattctgaatatttcatcaggaatcaagggaagaaggtacgttctggtcagaaaaatagaaactatggaaggaattccaaagaccattgcaattttaaagttgatcaatccttttttaaaatatgacactgaacctacaaggctgcttatgcctactataaaaagagaatattctgttgccataaaggcgtcgataccaaaaagataaacgaggacaggaacggtgagaatacttcctccacctcctattaaaccgagagaaatgccgataaaaacggctgccatatatcctataatttccattttactattcaaataattctgatgcaaaaatggaaaatcaggatgagggctacagctacttttgttacataaggagattgcttcacctttgattcgcaatgacaggttaaccaccccgtcaaaaattctttgaatttttgacacccctccggaggaggggaatataagttcctttgattgaagtgaagtgaatgttaagaattgagggatttcagaagggtaattttatttcttccgagttttagtttcccgtcttcttccagctgtttgaggagtctggatacgactactcttgcggttcccagctcattggccagctgctcatgggtggtatggatggcttctgaacgggtaagctctgactttttctgcaaaagattcagcagcctttcgtctacttttttaaaggcaatggcattgatgatatccagaagctcttcaaatcttttatggtagagcctgaagatataatccagccattcgggatgttctttgatgaataaagacaccttatccagtggtaagaaaagtatttctgcatcttcctcaatctcagctctcacaatacttttttcattgtgcattccgcccagaaaagacataatacagctctctcctgctttgatatagtacagtaaaatttcacgtccatcttcttctgttctgatgactttcagcattcctttcatcacaataggaatggaacggatggaggcattttcatctaaaataatatctccttcatggtaattttttgttgtaccatactgatagagcttttctaccagctccggagatgatgaaaattcggaagaaagtatggtgtcgtcctgcattttttattctaatttacaccaatttcatcaacaaacaaccatgctttagaatctgctccgggatttcctgccgggataattcctgcattttcaatatttaccttaagatattttgcattctgtgatcctacatttactttgattttgccatgggcagcctgaatttccgatgcctcgatttctttgatcagtttaaaattcctgttatcatcaaaaacaaaaatctttgcggactttgcaaggtgaatccagcttcctttattttcaagagtattgaaataaacttctgaaaaagctgttttctggccaaaatctattgttgccaccacgtcttttccctgaaaaccaagccaggttttacccaattgctttatatttccgataataccgtccactaaagtaaaagcatcaccgaaagaatagttttcactcggctgttgttctaaggttatattctttcccgtagtttttgaaacaataaactcctgtgtagaaacagcactcttcaactgaccatcttcaaaataagctgattttatcgttaaagaattaggaatctgaactgccttctgatacgttttagaattaagcgtaggaacagttccatccaaagtatatctgataccgtttgcattttgtgaggttgacagttcgtaggcaattccgttattggaaggaattacttttccggtaatgttataaatgcttcttgcatagttcactttcatttcatcaagaattttgaactgattaatcaccctgttttcaaattctttatagttttcaggatctgatgttccccatcctacttcagaaagcgccattaatcttggaaagatcatgtactgcacctgtttaaaatccaaaatatattctgtccaaaggttagcctgaacacccatgatatatctggcctgctctgcgtttagctcggaagggacaggattgtaagagtatactttgtctaaaggagtaaaaccgccaaaagcattaggctccgattgaggatcaccctgataatgatcaaaataacagtatgctcccggagtcattacagcaaagtgttttgattttgctgcttcaatacctccgtttacaccagtccagctcattacggctgcattcggtgctaatcctccttctaagatttcgtcccaaccgatgattttccggcctttgctgttcatatatttttcaatacgatgaataaagtaactctgtaagccatgttcatcttttaaattattttttttgatcaattcctggcagtgtgcacattctttccatcgtgttttcggacattcatcaccaccgatatgaatatattgagatgggaaaagctttatcacttcatcaagaacgttttcaagaaaagtaaatgtttcatctttcgggcagaaaacatcatcaaaaacgccccattttgtagccacttcaaaaggtccttttgtacatgccagttcaggatatgcggacagtgccgccaaagcatgtcccggcatttctatttccggaacaacagtaatatgcctgtcctgagcatattttaccacttcttttatctgttcctgagtataataataaggtccgtaaggcgtaccgtcaaatgtgttgtcaacgtaagctccgatcatagactccttacgttttgagccaatctgagtaagctttggatattttttgatttcaattctccatccctgatcatccgttaaatgccagtggaaagtattcagcttgtacatcgcgagatagtcgatatactgcttcacctcatctactgtaaaaaaatgtcggcagacatccagatgcattcctctccaggcaaactttggctggtcttcaatttttaaagcaggaattttcttagtttccttatattgttcaaaaatctgaatcagagtctgcagcgcaaggaaatacccttgtctggtgtaagatttaatatgaatctgtttcggagaaatttctatggaataatattcttttttctgttcagtattgactgaagttgacggcattacagtattgatcagatgaatttcattccctttctggatattctgaaatttaaactgaggacttaaacgtttcttaaaatattccgtctcttcttttggcagattattgcttaatacaagcgtttccggaattacaaattctccctgaagaagctcaagcttttgagggtaaggaattaaattcaatttattttgggcaaaaatcacgtttgaaagcaatataaaaaatactaaaaaagtccgtatcattgaaagtggttaaggtttgagctaagataattatttttcaaaactcccggagtctttttaaaaacaaaattcagatatcttaattgttcgggtttttatgaagcgtacaattttaaattgctaagtgacttctatagaaattgttctattatattctgtatattatggtttgttttttgatcaactttgatgacttaaaaaaattaaaaggcttaaatttgtaaaaaaatatgatgaaaaaaagcatttttgtggcagccggattattattctcaatgtcagcacaggcgcaaattttagatattataaaatctaccgttaaagacaaaaccggtgtggaccttaatgttccggtaaaaaataatggtacggcaactccaaccaagactaccactaccacttctggtaattcttctgccaatattggaaacctcacttctactcagatttcttcaggattaaaagaagctttaagtatgggcgtaaccgatggggttaaaaaactggcagtaaccgatggttttttcaagaatgaagcggtaaaaattttaatgcctgaaaagttaagaaagattgatacaaccttacgttccatcggtatgggcagtcttgcagatgaaggtgttaagctattgaacagagctgctgaagatgccgtaacagaagccgctcctattttcaccaatgcgataacttccatgacgattacagacgcaaaaaatattctgttaggcagtaataatgcagcaacaaattatcttcagggaaaaacacaaacccagcttttcaatgcttttcagcctaaggtaaaagcttcgttaggaaaagtaggtgctgatacactttggaaaaacctgatttcaaaatacaatacatttacagggcagtctgtaacaacagatcttaatgaatatgttactacagaaaccattaacggagtgttcaaaatggtggcagataaggaaagcgggatcagaaatacacctgctatgagaacgacaagtattctgcagaaggtttttggggcacaggatgggagataaatgaggagttagatagtagaggataaactaaccgatacgattttaaatataaaagctgtttcatgatgaaatagctttttttaatttcttttgtcttaaaacaaaagaaacaaaaattcaagacctggatctctccgctaaaaataaatcctgttctctaaaaattctaaacttgcgcgaaatcattatttcttaatcggttctgaatttgtctcgcgcttcggacaggagaattttcttaacgttcacagcatttattttcatcacgctccaatctcctatgtcgtttatttcttaagatttataaaaagtttcggcctcactttgtgaggccgaaacttttttatttttaaacagattaaaactgcatttcaggaatttctccttcaatgatcagatctgcttctgtcgctttgataatatcttctactgagacacccggtgctctttccaccagcttgaatcctgccggagttacatccagaacagctaactcagtaaccacttttttcacacagtttactcctgttaaaggaagcgtacattttttaaggattttactttctcctgctttatttacgtgcatcattgcaacaataatattttctgcagaagctacaagatccatggctcctcccattcctttcaccatttttcccggaattttccagttggcaatatctccgttctctgaaacttccatagcaccaagaatggtaaggtctactttctgaccacggatcatcccgaaactgaatgcggaatcaaaaaaagaacctccttccaatatagtgatagtctgttttccggcattaatgatatcagcatcttcttctccttcgaaagggaaaggccccatccccaacactccgttttcactttggaattctacggaaataccttccggaacatagttggcaaccaaagtaggaatcccaattcccaggtttacataataacgatctttcagttcttttgaaattcttttggcaatttgttcttttgtaagcataataaaaacttagactgcaatttaattattttcacttgaatacaaaagggctttgttgtattcaacaattaacactgttagttaaaataatatctgtaattttgcttcattattttaacagaatgaaaatactttttagatatcttaaaccttatcagtggctgattatcatttctttgtttctggctactgtcaatcaggttttttcgttatttgccccggctattacaggaaatatcctggatcaactggttacccatcctaacttttttgataaagagaaactgcttcccagaaatctgaacgaatatttgtatggaagctccgcttatcatggtgctttttactttttgggattgcttatcggtacggcaatggtaagcagaattgccaaagcttttcaggattatgtggtaagcgttattacacaaaaattcggagcaaaaatatttacagatggcttaaaacactcgatggcgttgccttatcaggaatttgaagatcagagaagtggggaaaccctttctattttaacgaaagtaagggaagacacggtaaaattcattacaaatttcatcaatattttcttcggaattctggtgagtattattttcgtgtccttatatgcaatccgcttacactggtctattatgccggtttatatctgtggaattttctttattgccattgttacgaatttactgagcaaaagaataaaagtcatccagaaaaatattgtgactgaaaccacagctttggccggaagtactacagagagtttaagaaacatcgagattgttaaaagtttaggattaaccaatcaggaagtaatccgtttaaataacaatacctataaaatccttggccttgaactgagaaaggtgaaaagcatccgttctttgagttttatccagggaacaatggtgaattttcttcagcagatgattaccctgacattattgtatttgatttttaaaaatattgtgactccgggtcaatatctgtctctgatgttttatggcttctttattttcgggcctatgcaggagattggaaatatcatcatttcttaccgtgaagcagaggcttctcttcagaattttgaccgtttaatgaaaaaggaagtggaagaaaaaccgcttcacccgaaacagatcggtgctattgaagaactggaattcaagcatgtttctttcaaacatcaatctgctcagtacaaagctttgaataatatttcctttgatgtcaaaaacggagaaaccattgcttttgtaggaccaagcggttccggaaaaagtaccctcgtcaaattactggttggactgtacagaccgcaggaaggaaatattttttataatggtattaatggaaaagaatttgattttgatgagctgagaaatcagattggttttgttacacaggatactcagttgtttgcaggaaccattaaagaaaaccttctctttgttaatccttctgctacagaagaggaactagcaattgctttacagaaatcaagctgtacggcattgctggaaagagcagaaaagggtattgaaaccattatcggcgaaggcggtctgaagctgagtggcggtgaaaagcagagaattgctatcgcaagggctcttctgagaaaacctcatctgttgatctttgatgaagctacttctgcgcttgacagtatcactgaagaagaaatcaccactacgataaaagacatttcaaaagaaaaagaacagattactgtccttattgcccaccgtttaagtacgattatgcatgcagacaaaatctatgttcttgaacgcggacagattgtagaaacgggttcccatgccaatcttattgacgaaaaaggactgtactacgccatgtggagacaacagatcggggaaagaaaaacacttactcctcaagcataaaaaaagcgctgaaactgttttcagcgctttttattttattatttaagcttattctttaggtcttactgttctctgctcaattcttttttcaaatttttctccctggaaaattcgctgaaccataattcccggaatgtgaatttcattgggatctaattgtcccggttctaccagctcttctacttcagcaatagtaatctttgcagcacctgccatcggatggttgaagtttctcgcagaacctttgaaaataaggtttccggcatgatctcctttccatgcttttacgatagagaaatctgcatcataagcgtgctcaaggatatgaggttttcctttgaattcttttacttcttttccttcagctacttcagttccgtaacctgcaggagtgtaaaaagccggaattcccgcctgagcagctctgcatttttcagctaaagttccctgtggagtaagttctacatccagctccccggaaagcatctgtctttcaaattcagcattttctcctacatacgaagagatcattttcttaatctgtcttttgtgaagcagtaagcctaatccgaaatcgtctactcccgcattgtttgaaatgcaagtaagatctttcacatcgctttctaccaaagcattgattgagttttcaggaattccgcaaagtccaaacccaccaagcatcagtgtcattccatctttaattccttcgatggcctcctttgcattttttactcttttatctatcatgaaatattagatttttctgttggctaaatttaataaattttcctgtatatctgatgaatggaaaagcctttggaatttcacattgttttgccaccatataaaatcatagaaatcaaatatttacccataaaaatgaacagatctgttcgttttttgtgggatttttcatcaagatgatttatctttggggctttaaattcagaaatacagcttatttgttgttttcagatatcattttaaacacaattttaatgtagaaattattttatgaaaggcagctattgtcgctttacttctttggtctatacacagatcttttatatcaatcgtcacattaatcatatacaatattaagattacataaaaacatgaaaaaattacttacctcagcattacttgcactggtacttagcgtcaatgtgtgcgcacaggagagaacttatttcgatgaagactgggaaaaaaccactcaggataaaatggaatattaccgtgaaacaacttcaaaaggaaaactaacctttatcaaagatttctataaggatggaaaacttcagatggaaggtctcgcttcggatcctactcccaacagtgaagtctttgagggaaaagtgacctggtatacccctgaaggaaaagtatcaaattttgccacctattccaaaggtcagcagataggtcctgcccagacatatgatgttaaaggccgactgacagaagatgtggtatataaagctgacgggactttttcaggaaaaatgttcagctataaagatgctgaagaaggggttgattttaatatcctggttgattatgaaaactccatacctgtcaaaacaacgatttatgatgatgacattaaaggcatcagaagtgaaaccattaccggtaaggattacaatactgaaacgaagtattacggagaaaaggggaaatatctgggaagcggcactaccggtccaggcgaaaatatggtagttgattattattccaacccgatgaggatttccaggatagagaaatacagaaatgatggcagtgtaaaggaaagcgtatcctatagcaaaagcggaaaagttttacaggagcagaaaatgaataagaaagatggctacaaaaccacttatgatgagtcaggcaaaaaaataggacatcttatttatcagtatgataaggaaagtgatatttacaatccaatggatggtgaagattaccagatttcttattcacagatttcatcgatcgatatgtatgaaaaaggctcgattgtaaacagtaagatctttgatgaaaacgggaaattatcctatgaaaagttcttaaaagatgacatcacgcaggaaattaaatattatgctcctgatggaacattgaaatcaacattaacgtataaagatggtattccttatagtggttcatcttatgaaggctttaatgaaacagtttataagaacggtattatttcgaatatcaaaaacttttttgaagatcatacgctgaattatgagaaaaagctgaatgctaagcaaacaagctatgaaacaactgtatatgacagaaagggctctgttctgtatactttttcacaacctgtgagtgaagacggagaagattattcctttacggcacaaattacacaatatgtaaaaggtaagcctgccaataagtcttctgtaaaagaaggtgttattcaatccggaaaaatcagactaaacacattagatggtgccaaagaacttgaacgtaacggaaaatgggttcttttaagactttataatacggatggaaagcttattcaggaaacgaagacgctggccgatgctcaggatgaaactgcctctgctgaaaaccagacgctgttaagtgaggatgatctgtacaatcagtttgactaattatcacaactataatatcaaaggcggtttcaatttttggaatcgcttttttttatttgtccacaaatgacatagatttttataaacttatgtgaacttattctctgtaagaatatcttcttaattagcttaggtattcaaaccttttgtggcttttgtggtttgttttgaccacagatgacgcagattttcaaagatgattatgggaaattatattttttattgatataaaaagagaccatcatttctgacagtctcttcgctataattgtgttttagtttaccttactgaataatcagctttaaagtaaacagttttcttccgtgtacttttacaaaataaacgcccgcaggaagattttcattcacgagagaaaaacgctggttattgatattttttgatacatacagcagttctcccgaagctgaaaccaattcgattttctcaatcgggtagtcacttttaataaaagtaggctgccccggtttggttgggtttggatataagactacatttttctctgtacttcttgtttcttcagttcccaaagtaggtgaagttacctggaactgtaccctgtttgaaacttcggtataggaatcattggtaaacattaccatatagtaattccctggcgttgcaggtacagctgttccctggatggtttttgttccctgagtcactccgtcaaaataggtgtacgaaacaaaattatcatccggagtctgaacactttgaggataaattcctaaccagtctttaatgattcccggagaatccgtccaggaagcggtaatattttcacctaaagtataaacaggtttgttgatccaaagatctgtaacaatatcccctactttaaagaataccttctccccgattccgttatatccgtcttccagtagatactgagcataataatatccttttggaagtcctgtaaaattaagagttccggatgctgttgttacataactccatttgatagaggctgtagttcccggagtttgtcccattttataaattccaatccagtctttctgtaaattgggcccgtttgtaaaattaatagtaaccgttcctcctacaggataagtatcggcagtagcctgaagctgtactttcggtcctatgtagaaattttttcttggagtgatttccgtatatccgttgttggcaaaaaaacctgcaaaatattggcctttattcggaagaccattagtgaaagttacggttcctgcagtctgtccattcgtataaatatatccttgtgaagtggttgttgccggagtttgtccttttttatagattcctatccagtcctgctgatttccgggacctcctgtgaaagtagctgtgatagcttcattctgagcatattctgttttgtttaaagtaaaggtcgggtttgacactacacttcctgtaatttcaaactgcttcacatcactccactcactccactcaaggtttctgtccctgtaacgtgtttttacgtaataaattccgttcggaatagaattcgctgccaaggttgctttagtgatatctactccatcattcaggtttttggttttatccggagttccgtttccgtcttttccgaaccagttttcaaaatcacggtaaaattctttttcaattacagaaaaattcgaagctttactgatcaggaactgagttgtattcaacagctctccgttggaagaagaaaacgcacttccattcaatgttaaaggtaaagtaatcggacctgaaaaattgtttgtaatcgatggtttcgccggcttaggctgatttttatacctgtggaaagaatctaccagtacattgtttttcttattgtacaccccaccgatagaatagcattcaacatctacctttccggttggaacatctacttccacaatctggtacgtccagtctgtcaacgttttctgaacatcgtcaaaatcctgttcatttgacattccccaatactgatcccacgctgttcctccggaaataatctgatagtttggagtatttttaagctgacctctgtggtatagatgatggtgagctccaacatgcatcaggtatttgttggaagttaccagaagcggcaccgcattttcccttacccatgttgagatgtctcctacatactgctcagcctgatagggtctgtggcttaaagaaataatccagtctacagtcggatcatcattagctgccgtcaagatctgctgaagccaggtctgctgtgctgatcctgtatgttcggaacttaaacttacaaataaaacgttcccggcctgctgagcatagtaattctcatttccggaacttatattcttatatttgatttcgtcaatataaaagtgggcataataagaattcattcctaaagtaccgtaggtttcatggtttcctaccgttgtctgaataggcaggtacggagatagtttgatattctttttaaagtgaacattctcataatgatccagtgttcccacatccacctgatctcccaccataaaagtaagggcaatattatctgacggatcggaagcagccccgaatttttcttttaattttttataagcattcagcgtaagggtgtcatatcttggttctgctttgatctggttgtcacccatgataaggaaacggatctttccattggctgttgcagcctgtcccggcagaggaagtgttctgaaattataaacagcagactcactggttcctgtttttattttataataatactttgtattaggctgcagattggtaatctttgctgtgtgataatagtagttattgttgtatcccgtatctgaaaagatattggtggttccggttaccgtcacgttcagattggttggagaatctccatagattactgttgtttcattattggaagaagttttccaattgacgatcatggaattcggagtgggattttgtaaataaggaaacaaaacctgcccgaaagccatctggaccgcgaaacaaaaaaagaagaaataatgtttcataatcgttttcgttttaaaataacatatagaatttcgaattgtaaatcagtcatttaaaaatcattgttcagattttcatttcgggcaaaagtagagttcatatataaacttttgctgatggtattttaaagaaaccgttaaattttaaacataatcgggaagaaaaaattatagtttttagcacataaattatttggcatatttgaaaactattttgtacatttgcaacctgttattcaacctctgacgaaaaacgtgtaagttgcttagctttaacattttatttattaataatggatttattaaagtacgtacaagacaagtacatcgcgaaaaaagaattccctgaattcaaagcaggtgatacaattactgtgtattacgaaattaaagaaggacaaaaaacaagaactcagttcttcaaaggaacagttatccaactgagaggtactggttctacaaaaactttcactatcagaaaaatgagtggtgatgtaggtgtagaaagagtattccctattaacatgcctgcacttcagaagattgaagttgatagaagaggtagagttagaagagctagaatttactacttcagagaccttagaggtaagaaagcaagaatcaaagacgctgcttacaagaagaaataattcagacaacaatacatacaaaaagaggctgtttacttataaacagtctctttttttgttgaaacatttccttactttctatatggggttccacttccggtttccagaaacttttttaaactgccaaggaattgctgccatccgccggaacagatttcatagcattcaatatccggattcaggccgatatgcgtaagctttacctgagtgatagtatttttcagctcaatttcccagacaattgttgtcccgatccattctgtctgattttttaattcaggaagcgcaatcagtgaatcttctaccaaccagacaatttctgcattatccgttaatttttttatccgcattgttttgtgaatctgatctccgaatcttatggtaaagacgccgtctacctgagaagatgatccttcaaacatttcagtccaccaaagaggaatttcataggtcagggcatgatatactttatctgctgtagcattgacctccattacatgggtgtaattctcaacgctatttgtagtaattgttttcataaaattattgtattagctactacaattttatgtaaattattctgaatcagacttttcataagacaagaaatatgcgaaacctcaattactcattcttcaaaagatactgcaaaggtgttgttcctgtatgctttttgaaaaactctataaaagcactgtctgaggagaagtctaaaatatatgacacttcccctattgaattgccttcagccaaaagttcaatcgatcgctgaagccgccattgctgtctccaatcctggtaagacagcccggtttcttttttaaaaatgcggctgatcgttttttctacagctccggttttttgtgcaagatctttcagcattgatggtacagactgccgtaacgtccattcttcggcaattttcgtaaagcgcttatcctgtggcattttaagttccagtttttcttccggagctttactcatttcatcccagaatacttttaaaagattagtctgatcattactaagggccgaccattcccaaaaacaaatcctttcaataatctcctttaataaaggatttacatacaaaatcttcagatcaggttttatatatttcctggagtagcttacgtcaaaatagattgatctgtaggctacaatattcctgaaattcacccggtgaacttcaaaggccggaatccaaagcattctgaaaggaggaagaattaactgcctgtcagaggtagtcactgtcatacagccggatggtgcatacaacagctgggcttttgttgtatgaaaatgaaacccggaatcatgcattaccatatcagaagctatgctgactacttgttcatgaattgaatctgcatcaaagtcttcattttgtttcagtacagccatgtcctatttttgatattttttgtttttatatcattataaatatacattgattttttggaaactttgcagaaaaaaaatgagaaagacaaacccaatctggctcctgactttacttgtcatgcttccgcagtttgcagaaactatttacagtcccgttttgccgatggtacaagagcattttggaatcaatgaagaatcagcaaccctgaccatcagtttatattttatagcatttgccttgggtgttgcattttggggcgttcagtgtgacaggatcggaagaaaaaaatctttggaatatggtcttatcacctatggagcaggcactctgacggctgttttcgctcctgattttatcactctcctcggtgccaggattatttccgcgttcggaattgccgtaggttccattgtaacccagaccattttaagggatacttttgacaaagaaaatatcagcaaagtattttcctggatcgggatcggtttgtctgtcagtccggtaataggaatggttaccggttcaatattagcctcctttggcggacatcaaagcgtatttattacgctgtgtattttgggtttattttttttactgctttccaggcagaagatttctgaaactcatcattcaaagaaatccgtcaacttaaagactttgatcaatttactgaaacggatgcttcatgaccagagcatcattaagtgttgtttactgatcatgagttttaatgttctgctgttttcttattattcactggctccgtttatatttaaagaaaatcattattcttcttatactttcggatacagcagtatcattctggctggaggcacattcgccggagcaaagttcaaccggtttctgctgctgaaaaatatacaacccgaatatttagtgaaagcgtctacattttcagcatttattgcttcggtatttgtctggattcttatcaataaaggagtctgttttttaatcccttatttttttatagtgatggcattcagcattgccattccgaatattctgagtaccgcactcattaattacaaaaatgaaacgggaactgcaggagccttattaggattaatgtattatatactgataggttcaggactgataagtattggttttatacaaaatctgggcatttcgtgtgtcttcttttcaggaattggagtctgtactttattattctttaaggacaaataaattaatttactgtataaagttatacagtgcctcaaaaaatttcgggtatacttcaatatgaggaagatgtcctacattatcaatctctacaagctttgaaccggcaatttcgcgttgggttttctttcccagttcctgatactgccccattttaggttgaagttctttaggagctctgtcctttcctatcgcggttctgtctctcgtcccaataataagcaatgtaggaactttgatatttttaaattcatagcataccggctggttgtagatcatatccgaagtaagcgctgcatcccaggccacctgaggataatctttatgaagagtccaccctgcaattaagtcaagccagggttggtattcttctttccatttattatcataatagaatttcagctgataatttttataggtttccgctgtgtttttaagctcagactggtaggcctgatcaatggtctgatacgctgcgaaagttttataatcttcaagtcctatcgggttttcgagaatcagcttctgtactttatcaggatacagtaacgtaaatctggtcgccaccattcctcccattgaatgcccgagcactatcgttttatcaatttttaattcattcagaaccgctttggtattttctgccagctgtgaaaaggaaaactgataagcatgaggctttgaagactttccaaatcctatctgatcaggaataattactctgaatcctttagcagaaaggtctttcgctgttctttcccaataagctccattaaagtttttcccatgaagaagcatgattacttttccatttggtttttgtggctgtacatccatataagccattttcaaatcttctccctgagacttgaaattgagaaaatgaacttcataaggatattgataatcagataacattgcatccaaaggtcttatctgcgaaaatataaaaccggacatcgttactgtgaaaacggctattatttttctgaaatatttcatgaagctttattttaaagattaaaattaaaaaaaaccgctccaacgggaacggtttcaattgttatttttagttaaatattattaagacacttctgccattgaaacttctttttctttttttgaaggtaaattcatcaaaacaatagcaaaaagaatcagggcaatccctacccattggatgaaaaatactttttctcccagtaaaacaaaagccatcgttacagaaaccggaagctcaagagatgaaacaatacttcccaaccctaatcctgcattcgggaaaccgatattgaataaaaccggtggaatgattgtcccaaacaaagccagaacaaaaccgtatgtcaggaaaattgaatagttaaacgggtgaatatgttctgtattatctgtaaaatttaagtacaatgattttaacccattaaaatacattggtcctatctgggcaaagaataaaaatgcaaaaaccaccacagagcctcctgccagcatgatgatactctttctgaaaaccggaagatgggtagccagcgtattggaagtaaacatcgttaaagtatatgaagcagctgccatcaatccccagaagacgccatgccagtcaagttctatttccatattaataagattggttgccagaacagttcccagcaatacaataattacagaaactacttttcttgcattaggaagtttccgggtaaggatactttcaactaccacactgaaccagaccgactgcatcagcaatacaatagcaatggaaacattgatgtattgaactgcaatataatagaacagactcgttcctccaagggaagttcccgcaagcagcaacattctgacttctttagaacttggcgccgataatttctgcttcgaggttagggtctgaataaaattaaggatcaaaagtcctgtcaaacctaatacgaattgggaagtagttacttctgaggttgtaaaaccatcatggtaagccattttcacaaaagtggccaacataccgtatatactagctccaatccctacaaataaaacaccttttagtatatttttcttcttcataatttttttaacagcctgcaaaggtacgatatataaattaaatgatattggaagtactgtgataaaggataaataaaaatttcgtccagcaagtattataagaaaccctaattaatgattattcttgggaatttatatactatgtttatggatcaaacagtgattttccttttaacttatgttaaaatttaatttttttgcgttaccctattgcataaaataaacgaaaacaataagttagctatataaaaatttaaaatgaaacagtaattattaccgttagtcggactaacaacaccattgtattgttcagtcagaacaatctaatattttaaaaaactaataccatgagaaaacaattactttccctgtcatctttgctgataggatttttggggtattcccaaaccgatgtctattttaaatatgacgaagcaggcaatcaacgttaccggggtttagatgccaatgctaaacaggctggtgagaatttttcaaaagccgaatctaaaactacttctttattttcatctcaaagcatagatgagaaagcgttttggaaacagatacgtttgtatcctgttccagtcaaagatatacttacaatcgactggacagaggaggtggaaggcattattcaaaccgtttcactgtaccagcacagtacggtgcactggaagtttcagcaagagaatataccaagtctaaaccaacagcttaaaatcaatatgtctggttatgaatggggagtatatgtattacgttttacgttaaaggatggaagggttttcagtaaaaatatcaccaaacgctaattaaccatgaaagcttatcataaaaggatgaaagtcttttcatctattatatcctgtatatttatactaggatttgtaccattgctctcaggacaaaatttccatgatactaaaggcaatattgaagtaaacggagcgggccaattacaattttctttaccagttgccctaccgccgggggtgaaatctgtagctccacaagttaacttagtctacacaagcgggtctaataatggaattgcaggctatggctggaacctttccggtttaacagctatctcaagaaccggaaaaacagtagaaaaagacggagaatctaaaggggcacagctagattattcggattattatagtttcaatgggcaacgtttggttcttaaatcaggagaatatggcaaagatggtgctgaatatgttacagaaaaatattcaaatgtgaagattaaatccgtgggaacagcacaaacggcaactcctcaacctatgtattttcatgtaacatttgaagatggttctcaggcgtggtatggagacattcaggctgatgatcctgagctcaattctttgaacgggcgaacttccattgaatacaatattgtaaaatggaaagatcctcagggaaattatattatttattcatatgattataccacagggcagatgcaaggccgtgtaagcagaatatcttccatagaatggggcggaaatgaaactttaaacaaacctcatttcaacaaaattaactttaactatacggacagaagcctgattgaagatacttatgtagggggatatcgatttgtccagaatcaactgttatctgaaatacaggtaaatacaaacggaaatctttttaaaaggtatactgttaattatattaaaaatggtacaaactatcagcagattgataaaataacagagtacaatgctgataacagtgctgccaatcctataacctttacttatccccttccgacacagccggctttggagttttctaataataatgtagacagcttcgataatgtaagattaactggtgattttaatggtgattcttatcttgatttcattatgaataatggcgttgtgaaactcggaggtctgaatgatacttttactgatgtttctactggaaaagtcttcaattcagatgctaagattgtccatacattactagatgaagaaggacaggtttataacggaaatggaatcgttcagtatgaaagtggtaaaataaccggctatattttcagagacaatacctttgtaaaagtctttgaaaaagcattgtttgatccttctacctgcacttcccaaccaggtggtgtaggatgcagtacaacagtaagtctttttaatgaaggagatattaacggtgacggcatttctgatatatttgtgaccttaaaacaaaggatatgtgagtttgtacaaattcccggctgtactgacatagaccctgttctgtcttctgcgagcaagaatgacggagacggaataatcaagccgccgctctgtcagcaattacaatgtaattcttacgaattaggcaattttattgtagatctgaaaaatgcaaataacccattaggtacatatgttcttgatacaggaattaatcaaaattcctataccaatcaaaagtatctggatgtggatggtgatggaaaagtagatattattgacgtttctaattctacctatactgtatttgaatttattaaaaccgctcctgatcaatacctcaagaagattaaatttttcggtagtctggcagaaacaaaagcctctgaatatcccgtattattcggtgatttcaatggtgatggaaacctcgattttaccataccgaccacggaaacaaaagaaaaagataactggagattctatatgggaactgaaaagggattttcgaatttcttaaaaacagactttttgaagtacagaaagcctgatgattataaaaacagctcgtatcctacttttaatatttacagaaacttttattcggcttctgatattaataaagatggtaaatcagatattatacacatcaactcattcaataaggcaggccaggtaaattcaagcggcatgattattacaagatattttggttataatattgccacttatgcagctaatggtgtcctgaccaacggaactccggatttttctgccgctaatgactttggaggaacaaattatgtaacttttaacgtaggtgaatttactttattttcaccaattacctcgcaggtaaaagtaaataacaattactatgatgtgctcttattctggaaagagaggatgcataaacttaaatctccttcttctgttgcaagattatcacagatacaatcaatcacacaaggaggaatcactacatcagcagattatcttgaaatcattcctaataatagcttaactcctggtttttatcaaaaaattaaaaaagaatattacccttacttttctttaaacagaatggatcaatcttatgctgtatcacaacttagacaagaaggacggaagcaggatttccgatacagaggaatgacaggacatatgcagggcaaaggaatgatggggtatcatcaatctgcccgctcatcatggtatgctgacggatttgaaaacattaaagtgtggtcaggtgcagaaatagatcctctttttgatggtgttcctgtaaaagaatggagtatcaaaacaaatgatgaatcaaaaatattccctgtagatctgtctgaaaacaacacccagcttttaagctttaaatcgacagtataccagacggataaattagtaaacggacaagtaataaccggccctgtttctgatactgacaagccaaatcttgtaacggctactgttgctaaaaataccagaactaaggatttcctgacaggtacattaacaaacacatctattacctatggagaatattatcttccaaagcaaagtgttaccaatgtaaataacggttatgccataaccacttcaaaccttgaatatattcataatttatcaggtagcggatcagattatttttccgggcggcctcaatctaaaacagatattatacaggcctatggggatacccaatcttcaaaagaagaattcacctatgagaataaccttccgaaaactctaaaaaagtggaacaggaatactacaggatatgtgcttgaaagctataattatgatggtttcggtaatattactcagaaggtagtaagcaatagcatcgattcacaaacacgcacagaaacaaatctttatgaacctaaaggaagatttgttgcaaaaaaaacagatcatcttgcactggagactcttattgagtacaacgattgggggcagattacaaagcagacagatccattgggaaatacacttaccaacacctatgatggttggggaaaactgctaacctcctctaccaatctgggaggtacaactacttatctgtacaatagagataataattctaatattactcttacgcaaaatgatcccgatggtaatgtatctaaaaaatacaccaacaggcttggccaggaatacaaaatttctgcaaaggctttcggacaggggcaatttatttctaaggacattcaatatgatgtgttaggaagaaagctcaaagaatctgagccttattttgaggggcaaaacgctacccaatggaataccattgcttatgatgattctgtatttcctatcaccaaagcaacagctactgcatttaacggtaagaagatggaaactaccgtttcaggtctggtaacaaccgtaaaagaacttaacggctatggtagaaccaccacaaaaattcaggatgctttgagcaatgtcgcttctaccactgataaaggaggtacaatacaattctcttataatgcctccgggcagcagatcaaagctcagtatgcagaaaatattgttgttacgaaatatgatgtatggggcagaaaatccgaatttaatgatccttctaacggtctttacaaatacgagtatgatggattcgggcagataaagaaaatcataagcccgaaaggaaccaaagaatatatctataattctttaggccaactgatcactcaaaaagaactttccacaaccgataacgggcaggcaaccaataagacaatttcttttacttacgataataaaggtaagcttatctccaaatcaggtactctaaagggacagttatttatctctaattttacctatgattcctatggaagattgttatcatcttctgaaaacagtaatggcagaagctatatagaaaagggtattacctatgacaataagggcagaatatcctcctatgaaaaggaactgcagtcttcggggataattaccaaagctgagattgaaaacgtatacagtacatggaacggagaattataccaaataaaagataaagttactgggaaaagtctttgggaagttaaggaaacaaatgtcaaaggacagatattaaatgccaaacttggagctgctgatatcaataatacttatgattctgatggtttcttaaccaatgttaaccattcatcagcagtaaaaccaaatattctgcaattatcttattcttttgacgcgataaagaacgagcttaagagcagaatcacaggtggagactttaacattgttgaatcttttgattatgatgataacaacaggctaatcaactggacggaccctgttacgggaataaagccgtcagccatcagaaatgtctatgatattaagggaagaattacccaaaatgatcaggtaggagacatcaaatttgaaaattctgaaaaaatataccaaccgacaggaatgaccttaaatgcagctggtacacagaattacaacggtgatcttatccaaagcataatttataatgagaataacgatcctgtaaaaattaatggagagaaagcccgtataagctttgaatacggattaacaagcatgagacaacgtctcgatattgataagctggttcaaattggaggcggaggtggaagttcagattctaaaacaactggagtttgggatcctaacgcgccattatggcaaagaaccctaactaaattatataacgaagatggcagttttgaggtaatcagggatcaggctaccaaccaggaaaagcatattttatatattgccggcactccttatgagtccaatgtcatctatgttaaagattataatgaaagcaatgcctcttacagattccttcataaagattatataggaagtattcttgcgattagtgatgaaataggtaacaagcttgagcaaagacattttgatgcctggggtaacttaacacatttaaaatcaggaaatgacactactataacagatcaggctctgatccgtacctcagcattatttgttgatcgtggttataccagccatgaacatttaatggatgttggaattgtccatatgaatggcaggttgtatgatcctctgctaagaagatttctaaatgcagatgaaaatatacaggatccttataatactcagaactacaataaatatggctatgtactgaataatccattaatgtataatgatccaagtggggagtttcttcaattcttagccatcccaatcgtaaaagcacttgtttttgctgttgtatcctatactgccacagttttgattaccggtgcgaagtttaatatcctgaatttatattctaccattgtaatgagtctgataagtgccggaataacaacggtgataggagatgtattttccacagcctcagcaaccatcggaaatgaagctttaaaaagtctagtgcatgccggtgtgcagggaacattaagttttatgcagggaggtaatttttttacttcagcagcaagcgcattttttgctagctttgtatcttacggatatgcaaaagctgtaggatctgcagcatatagtggtgtaggtcaggtggcattcggaatgctcgctggtggtgttggctcctctcttacaggaggaaacttctgggaaggagtcaaaattggaggaattgtagctttgtttaaccataccatgcacaaaattactgataacctgaccattgataaagctaccaggaaagagttcagaaaattggtaagagcaaagaactatcagggagcatttgatctggtgaatgcaaaatatgatttagatgcagatattaaaggcaagtataccatgaaatatgaagacagcaacgagttttcaggattgacaggcggagaggcttttgaaaatcaagaagttaccattgccacacatgtctttaaaagctctgtagctgtttttataagggttgttcaccatgaatttatccatgtttaccaaagaggtgtcatgggatttgcaggaaatttaaacatttatgaagttagggaatttcttgcctaccatgatacattatttaatgacaagttgcctaaagcaacgttttcaggcatggaaggatattggaataaggctaagcaattttataaatacatgacggacaatcctgcacttatcaaggcatatcagtctcagtataatgattttgcaaattcaagtttttttaaataaaaattatgtacaagtttctattactattttttgtaagttttgtgtccgcacagcagacctgtaaactatctttttccaatacaccgctttcggaaaatggtgaaataatgtttacagttaaaaatttaaacaatgagaaaatacatgtaccaaagcggtattcaggtatatgggccagacctatagatattcaggtatacagcgatgaaaaaagagaatttcaggatacaaaatacagctttgacggggcaggctgtttagacacaaaaaaatgtttaggacaaatggaatgccttaaaaatggagaatccaaagaatataaggttatcattcttccgggaagaatttcaaaagcttttagggagaaaaaaaagtatagatttaagctggcttttgaaacctatcttttcagcggatgtgctgattataaaacagattggctttattatcagaattaattggtattattaaccataattattccctgggtagaagtgctcagggaatttttatttcactttatctggtaaaacttatatccacaaaaaaagccgctcgaatgagcggctccctatttatatcaatggttcaaagattatttaccttcttccatttttcttttcaactctgctaatgcatcgatgtctccaagagtagatctttcttcgttgttagaagaagaagttacgtttctagaagaagcttcttttacgtttttcttctcttcgtctctgaagatacctgtgtgagatactactactctcttgaattctttgttgaattcgattactttgaattgagcttcttcaccttttttgattttagatccatcttctttctctaataatcttgaagggcagaaagcttctacttcagcatcttcgaattgaacagaagctcctttatcgtgaacttctacagctttaccagcgtggatagttccttcagcatatttagtttcgaatttatcccatgggttttcagtcaattgcttgtgacctagagataatcttctagcctgaatatctaattcaagaactacaacgtctaatttatcacctactgcgcagaactcagatgggtgcttgattttcttagtccaagaaagatcagagatgtagattaatccgtcgataccttcttctaactctacgaatacaccaaagttagtgaagtttcttacagttcctacatgctgagatcctacaggatacttagcttcgatgttttcccatggatctttagacaattgcttgataccaagagaaatttttctttcttctctatctaaagttaatacttcagcttctacttcatcacctacttttacgaaatctccggcagatcttaagtgagtagaccaagacatttcagaaacgtggattaatccttcaacacctggagcgatttctacgaatgcaccatagtcagcaagaactactacttttccttttactttgtctcctactttaaggtcagcagaaagagcatcccaaggatgagcttctaattgcttcatacctaactggattcttgttttctcgtcatcgaaatcaagaattacaacttttacagtctgtccgtcctcaaggatttcagatgggtggttcactctagaccaagaaaggtctgtaatgtggatcaatccatctacaccacctaagtcgatgaatacaccgtaagaagtgatattcttaacagtaccttcaagaacttgtcctttttcaagttgagcgatgatttcttttttctgaccttcgatatctgcttcgatcaatgctttgtgagatacaactacatttttgaactcagggttgattttcacaactttgaactccatagtttttcctacgaactgatcgtaatctttaattggcttaacgtcaatttgagaaccaggtaagaatgcttcgattccgtgaacgtcaacgatcataccacctttagttcttgatttaacaaaaccgttaacgatttcaccagtttcgtgaagttcgtttactttatcccaagctttaagcgttcttgcttttctgtgagataattgtaactgaccagttttgtcttctcttttgtcaaccattacttctacctcgtcacctactttaaggccttggttgtaacggaattcgttaagagagataacaccttcagatttgaagttgatgtcaacgatagcttctttatcagttaatcttacaactttaccaattagaacgtcgttatcgtctaagttgtttaaagatccgttgtagatttcttctaaatcgcttttctcttttctagcatcagcatcaagaccagattcgaaagaatcccagtcaaattgttcaggtgctacgttttggtttaataataattcagctgaatttgtctcttttgacataattctaaaaaatttgtattccttctctttcaacggtcttaatcaatgtgattgaaaaatacggaagttattaatatttaatattttactttctcagacctttaccacaaaaagtgggtgcaaagataagcaatttatttaagataagcaatagatctcaccatctttaaagttcatataactccatgataatcaattgtcatctattcttttttcattaaacagtacagctgattatggaaattcttcacttcgatgccctacgctcagaatgacagtaacgtcaaactataactgatcttcatctcaaaccttcccgttcacaacctaaaaaccctcctactctcaaactctcaaactctcccactcaaaattcaactccgaaattcactacctttgcaccatggaactacaatcaatctatcagaaactgcagattcaggatatgaatcagatgcagaaatctacttataaagcgtctgaaaataatacggatattgttttgctctctcctacaggatcaggaaaaacccttgctttcttatttcctgttctcagaaatctgaaaaaaaatgtacagggcgttcaggctttgatcctggttccggcaagggagcttgctttacagattgaacaggtttttaaagcgatgggaacagattttaaagtttctgtctgctatggcggacatgataaaaaaattgaggtcaataatttaattgaagctccggctgtattgatcggaactcccggaagagttgtttatcatttaagaaataacaattttgatcctaagaccatcaagacattggttcttgatgaatttgataaagcactggagctgggctttcatgatgacatggaatttatttgcaattctttaaaaggactttcacaaagaattctgacgtctgccacaacaatggatgaaattccggcctttacaggattgaaagatgaaaaagtaatcagcttcctgaaagaaaatgacataaaaccggaccttcaactaagaaaggttatgacaattccggaggaaaaactggatacgcttttcaacctggtttgtaaaatcggaaacaagagaaccctgatcttctgcaatcaccgtgatgcagtagaccgtatctctgaacttcttcatcagatgggaatagacagggaaactttccatggcggcatggaacaggacgaaagagaacgtgccctgcttaaattcagaaatgattccgcaaggattcttattacaacggatctggctgcccgcgggcttgacattcctgaagtagaatctattgttcattaccagcttcctccaaaagaagatgccttcatccaccgaaacggacgtaccgctagaatgaatgccaaaggttttgtctacctgatcatgactgaagaagaaaacttcccgttcattaaaaataatacaccagaagaaagtgttgccgggtttactaaagttccacaaaaaacacctttccagaccatttacatcagtgcaggaaaaaaggataaagtaaataaagtggatattgtaggttatttactgaagaagggcgaattacagaaagaagatgtgggaattattgaagtaaaagatactacgtcctatgttgccgtttccagaaataaagtcaatgcacttttaagaaagcttcagaacgaaaaactgaaaggaaagaaagtgaaaatggaaattgcttattaattaaaacatcaaattaatatatacaaaaaatcagatatgaaaattaaaacattcattgcagatgcttttaccgataaactatttaagggaaatcctgccgctgtgtgtattgtaaaagaggctatcccggaagagaatatgattcagattgccaaagaattcggcttttctgaatcggcatttgtcattcaaaaagggcctgctgatttttctatccgttacttttctccggttactgaaattccattatgcgggcatgctacgatggcatctgcgaaagttttgttttcagaatatccgcattttgatacgataacattcaaaacccagtttgggcatattcttgagctgagaaacaataataaccggattgaaatggtgtttcctgtacatgaaaccgaaaaatcccagtttcctgatgacttaaaaagcgcaatcgggataaatgacatcatcaattgcgaatacaataaagaccacaatattctgatggtggaaatagaaaacagtaagcaactggaagatttagacccggattttgccacattaaaaaagatcaaaacaacaatcagcggagttctggtaactgcctcttctgtaagaaccggctatgattttgaatatcgttacttctggccatggtcggggtccaatgaagatccagtgacaggaggagtacagagttttttatgcaaatactggtctttgaaacttgataaaaaagttcttaatgccttccaatgctctgaacgcacaggaagcatggaggttgaattaaaaggcgatcagacaatcataagaagcaatgccataatattccttaccggcgaaattgatcagacaaccaattgattaattactcatactaaagttaaaaaaaactattttactcctttcaccttagtcggaagcgtgtaaacggattttgaagctgtaatgaagagcacatcattattttcccctccaaaagttacattagatgtccagtcttcctgaataggtatatgataaattttctttccgtgattattgaaaatatgaactccgtttcctgttaaatataaatttccatgtttgtccatagtcattccgtctgagcccatttcacaaaagagttttttctcagacagttttccttcacctaaaatatcatacacataagtctttccggcgtcaatatcagaaatgtacaatttctttaatttttcacttcctacaattccattgggctgtgtgaatgtttccagctttgtaacttttcctgttttatccctgtaataaagacttttatgaggaagttcctgtttgaaacctatccagtaatcccttttgtataaaggatctgtaaagtacattcctccaaattcatcattccacacatcattgggaccgttcagtctttttccttcaaaacctttaagcagaacttccacttttttatctttggaaattttccagatctctccctgatcgtctgaacaggtgatcagatacccgtctttgttaaaatgagttccgttggctcttcctgttttatcaagaaattctatcacctgattgcttttccagtcccaataatagatcttatcattaggctgatcggtaaagtaaacatttccatccttatctgctgatggcccttctgtgaaactgaacttatctgaaaccttttccggctgtactccttcataaaacattttactataatttactgattgacagtttaccaatgcgaaaaccaaaccaatcatacctattttaaagatattcttcatacttcatttttaaacccgcaatttacaatatcaataatagctttcaaaatattttctctttctgatacaataaaaaaatgcaatttaaaaatgtcccaattgtactattttttaagtagatcatattagcagcaaaaagatataatgcggagctttgcagtagcaggatcaatcattttttcatagaaatcaatgtgagaaaaaagatcggtcaggatgaaaattgtaccaaaatactttatagcatacaacaatgagcgcagaatccaacaatatcaagtctttggaaattgaaaatgaagatttcagaaattctgtaggaaccatggatgaaaccggaaaaaggaaatgggtttttcccagaaagcctaaaggtaagtacaccaactacaggaattatacaagctatcttcttcttgctttatttttcgggttgccgtttgtaaaaatcaacaataatccctttctgcttattaatgttatcgacaggaaattctttattctcggccagcctttttacctgcaggatttttttatccttgctttaggtgccgtaacttctgtaatttttgtgatgctttttacggtagttttcgggagaatattctgtggctggttgtgtccgcagacccttttcatggaaatggtcttccggaaaatagaatattggattgaaggagacaggaataagcagatgaaacttgacagacaggaatgggacgcagaaaaaatacggaaaagactgaccaaatggtctgtatttctcttgatttcactgatcatttcccaattcatgttcatgtacattgtcggatatgaagaggttttccatattatgagtgaaggacctgccgaacattcactgaagtttgtaacgatgatattctttaccatggctttctattttgtttttgcatggctccgtgaacaggtctgtacgttggtttgtccttacggaagacttcagggcgtattgattgacaagcaaaccattaatgtctattatgattttaaaagaggtgaaggccgcgcaaaatggagaaataatgaagacagaaaagctgcagggaaaggagattgtattgactgtaaccaatgtgttgtagtctgccctacaggaattgatatccgaaacggtcagcagctggaatgcgtgaactgcacggcatgtattgatgcgtgtgatgaagtaatggaaaaagtaggtttgcctaaaggactggtacggtatgctacggaagctgaaattgaaaatcaacacaagttcagatttactccgagaatgaaagcaaacactgtaattcttgctctgttaatcggatttcttggatttttaatgtacgaccgtggttctatggaagccaaattcattaaaccggcaggttctacctttttcgttaaaaatggtaaaatcaccaatacttttatttatactcttctgaataaatcgaatgagaagaaaacccttaccattaaagttatcactccggcaaatgcggaaatcacttattttggttccgaaaaaatcatattgaaaggagaccagatcctgaaaggaaacatcaacatttctttccctgaagacgagattaagttctcaaaacaaaatatggtgattggagtgtttgatgaaaaaggaaaacttgtggattcatttgagacaacttttgaaggaccatttaagttggcactttaggttgcagatagcaggtatagtttacaggaatagtcattgatatttccattattcccctcttctggaggggtggcgaaaattcaaagaatttttgacggggtggttccaataatctctcccctgaactttaaactttaaaccttaaactttaaactgattaagctttatatttcctcataaactgtgtgggagtcattccggagcttttccggaatactcttacaaagtaggaatattcttcatatcccaatctgaaagcaatttccaccaggctttcgtccaggtacatcagcatccttttagcttccagcactactctttccgtaataatatcagtcgctgttttttgaacaacagtctgtgcaatcctgttcagatgtttggatgaaattcccagcaaagatgcgtaataagcgattgatttctgctgtgtaaagttctgctcaatcaggttttcaaaatcctgaaaatgtttaaaataagaaagtccggctgcggaagctaacgtatcaaagtcttttgaaaacaatctggcagcattaatgaaaatctgggacatcaatgacaaaataagaccttctttcataatattttttgcctgatgttctgcgcccagttcctgaaacaaacttacattcttcctaagctcctgggtatccagctgaagttttctcggaaaagatacagatccgaaaaaaggaaagtttcttagtttctgattgacataatgcatttcataaaattcctgggaacaaaagaaaatataaccttcaatatcctccgaaagctcccagctgtgaacctgccccggcgacagaaagaaaagacttccttcagagacttcatatttatgaaaatcaatttcatggactcctgacccttttgtaaagagaacggcagcataaaaatcatgtctgtgaggtttctctatatgacgatgtcccaccaccagatgattcttcatggtattaaagtaaaagtccgaagtatttttacccgtctgaaaaagatcgatatgaagaactgagatcggattcattactatgagtgtaagaatttacaaatttagataaaaagaaccggcatatggtaatccttttatatgacacttcatttactcctataaattcctttaaaaacaaagcctgacagcactttttgcaatatattttggataaaactttaaaaaatttttatctttgaagtttaggagttgtaaaatgaaaataaatttacctgataaactgtattattctataggagaagttgcaaaagcattcgatgtaaacacttcattaatacgctactgggaacaggaattcccgattatcaagcctaaaaaaaacagaaaaggaaaccgatatttcacccctgaagacatcaaaaatcttcaaatgatctaccatttggtaaaagaaaaaggttacacccttgacggcgcccgtgtagctcttaccaccaacagtaaaatttccgaaaccatcaccctgatcgaccggctggagtttgtaaaagctgagcttattaaactgaaagaatctctgggggaaaaggatagtgaataaggtcttcaaaatatagaaaagccgccgcaataaattgcggcggctttttattaattgattgattatggagctattcactgagatggaactgcaaaaaaaattagtcaattcgagatctttattcaggtaaaaattattcatcctcttttttaaaactcactaccagatattctccggttgaacaatattccttacagctatcatctttaaagctttcaggttttttggtgaactcttctatatattttgtgctttcagctgtatcagccggaacgataacaatatggtaattgtcaacaactgtactgtcagcttttttcaaagcctcttccttgtattttaatgcttcactgtatttcatagtactattaattattggtgttgaatagatatggcaaaaaaattacaaaaaccaagccgtttgaaggaaaagatgctacatagaaaaaacatccagaacttttagcttcgattacgaaattatatcacataaaaacgttatactcattatcttataaacaataaaacactttctctatataatctttaaccatttcatcatcagctattgctgtgttttatttttatcaataagtttacttcatgatgagaaaaaactattaccggaaactggcatttatggtcaccttgctgactgttttatttgtctatcaaaaatatacaagccgggaaaaggagccttttcctgaggttacattcattgcagatgcttcagcacctataagcctagcagattttgatcccaatacgttaaacaaagagcaatggaagaaactgggattttcagaacagcaaaccgctaccattcttaagtataaagatatcgtaggcggaaagtttatttcaaaagaacagctgagaaaatgttatgctatttctgaagaaaaattcagtgaacttgcatcttttatcatgcttcctgaaatgacagaaaaaggaaattcaaaaggattcaatacaattgaaaaaaaaggaattatcatttcaggaaagttcaatcctgatcagttttctgctgatgactggctcagaatgggtttcagtgaaagacaggcagaagccattataaagtataaaaattatttaggcggaagctttataagtaaagagaaatttaaagaatgctttattatttctcctgaaaattacagcaaacttgagccctatattctactaccggcaaaaactcctgaaaatttcagaaattttgcgaaaaacaatcctataaaatctaaaatccagtattacacttttgatcctaatcaattaaatctgaacgagtggaaagcgcttggattctcagaaaagcaggcagccaccatcatcacttaccgtgacaggaatctacagggaagctttaagaatcctgaagatctgcaaaaatgttttgtgatttccgctgagaaatttcaggaaatgaaaccttatatcaaacttcaggaaaaacaacaggaaaaaactgatttttcaaaaacagatcttaatacgattactttcaaacagcttatagaattcggactggacgaaagaagcgcgggttcaatcattagtttcagaaataagctgggaggttttatgaataaacagcagattctaagcacttataatattgatcaggatcttgttcaaaagctgatttcaacagcaccgttgaatacgtccaatgtaccaaaatatacactagtagatgcacctgaagtatggcttaaaaatcatccttattttaaatattctgcagacaaaatcatatactaccggatcagcaatccggatgataaaaaaatatggagactgttgaaattaaaacccgaatacgaagaaaaaatgaaattatacataaaataaaactattccaaaataacatcccggaatagttttatcaaggttaaatactgaattttaatgatgcatataactgctggggccgttggttccttcaatcgattcaggcagtattccatatttgttacgcagatctactgttcccagtttttttccggtattaatatcaataatactgatggttccggagtttaaattaggaagatccaacagattattttgtaccgctacaacatcttttcctgatctggttttaaagaaagccatatgatgagctcctttatcagcgtcaaaagttttcaaaagtttcagctgaggaagattgcttatatcaaacacaagcacttttccaggatctgcaaaacttacgtaaagtttattggaatcatcaatatacatttcaagtgtccagcctaacccttgtgtgcttccgtcaaagatcttcgtaaaggcatcatactttttggttgtattattgtatggagctatccagatatctcctccaagcatggttgtagcaagcgcatactgtggaaattttccacgcagcagtaaaacttcaacaggagcagacaaatctgttggtgaatctgctacctgataggtttccttgatttcataagtattcaggtctaataaagtacaggtatttcccatccctgttgtaagatccggatgaatggtagaggttaccatcatcaaccctttttcttcattaactgaaataccatgcggatacatgataaatttgttgggattactctgaacaggtgctttaatcgtcttgataagctgattattgttagcattaaaaaccccgatgctcccatctttcggacctcctgccccgcccatgaaagtcataaaataccttccatcattagtgaaaaataaattttcgcctaccgtattctcaccggtatcaataggggttgcacttatgagttttggctgcccattctgatcttttcccgttcttacttcatagaggtagctgcctcccaaagctgttgtaaacattttttttgcatcaagattgtaataaatatgatgtggcaatacaccaatacccaattcaagcttactgctgatgtttccaaaatttggagcttcaggatcaagctctataacagccattccgtctgatgctccttttaagcttctgtaatcaatgtaaaacgaagtgttatggggatggtcgggattgtgattctcgttcagacaactcgtaaatattgccaacgtaataaacaggaatactgaattaaattttaatttcatgattttatgattatggttgttagtcttataaatataatatatttcctgtgaaaaataaaacatattacactaatatgtgaaaaataatcgctaataaaaaaaataccatccggttataataccgaatagtaagaaattaaaatcgttaaaaaattctgcttttaatcaaaggttttactggaatcagtcagtaaagcgtttagcgtattaagctcatcatcagtcagatctctccactttcctaccggaagatcaagcttgatattcatgatgcggattcgtttcagcttttttacttcatatccgagatattcgcacattcttcggatctgtctgttgagaccctgagtaagaatgattctgaaattcatttcatcaatcttctcaacttcacattttctggtaatggtatcaagaatcggaacaccgtttctcattttttccagaaactttggagtgattggtttatcgacacgaactaaatattctttctcgtgattattacgggctctcagaattttattgacaatatcaccgtcacttgttaaaagaataagtccttcactaggtttatccagtctgccgataggaaaaatccttttcggatggttgatatagtctacaatattattcttttcgcgttttgtatctgtggtacaaacaattcctaccggtttattaaaaacgatatataccggtttttcctgaggttctctgatcggtttcccatctacttctacaagatcttcgtctgaaacttttgttcccagctcaggaatttttccgtttattttgattcttccctcttccaaaagcttatctgctgctcttcttgagcagtatcctacttctgataaatatttattgatacgcgtcttttccattagtcttttccgtagccggtataattttattgctgaaaataatatttttgtaagttaagcctgtaaaaaactagctgtattttaaggcttatgcattcatattcttacaggctttcgaatctgtaatcattatgcaggaactgatctgtagcatcttcaatcgcataatcacctattttggtacgtctcagctgtgtcagataagctcctactcccagttcctgcccgatgtcatgagccaggcttctgatgtaggttccttttgagcatcccaccgtaaaacttacaagaggaaaatctattttgatatctttaatataatgaatggtcgtttttcttgccttcatttcaacttcttcgcctgctctggcaaggttgtaagctctttccccatcaattttaatggctgaataaaccggtggtttctgttcaatttctccgacaaatttctccagaacttcttttacctgttcttcagtaatatgagagatatcctgatgaaggatttcaggcttttcagtatcataggactccgtctgtacaccaatcttgatctctgtccagtattctttaggagcatcctggatctctggaattttctttgtgaactttccacagcagacaatcaaaagtccggttgcacggggatctaaagttccggcatgtccgattttaaattttttaggaagatcaaattcccttttaagtttatatttcattttattgacagcctgaaaggaagtccagtccaagggcttgtccaataaaaaaatgtatcctgatttcagttcttcagcggtcattttttccaatattatttatttcttccacttgtttgaaactaactttatatttattgacaagataaagaagaattactaaaaatatagttattacagctttataataataatgaatataatcagaattatgattaaaaaataaagcaataaaagatttactatttattaataaaactaatacgaggtaaatatttattaattgtattgcaattctttttttgttaatcaagaaaatgaaaattacaattgcaaaaataagaatacttattgcaaaaatattatgttttaaacctacattataagcaaaaggatgaatatttaaaggaataatgataaagccaccgaggataaaaaataacaagcaaagagcattaacaaatttctttttaaataatattttttgcactatttaaagaaataaaagtaaatcaacagggcaattcctacaaaaatacggtaccagccccaaggtttaaatccatatttattaagtactccaatgaatgctttgatcgcaataagagccacgataaatgccactatatttccgatcacaaagatcataatgtgatcctgagaagccatgatcatttcatatcctttctgtgggtgggcagtttcttttccccaggtcttaacaaaaaccgaatataccgttactgccagcatcgtaggcaccgcaaggaagaaagagaattctgcagcagcttttcttgtaaggccctgtgtcattcctccaataatagaagcagcactacggcttgtacccggcatcattgcaagacattgccagaaaccaatggtaacagcttttcttattgtaattcctttttcgtcatcaattttaggattcttaaaccattcatcagcaaatagtaaaactacaccacctaacaccaatactgaagagatcgcaatctgatttccaagaacagcctcaattttatcatcaaataaataccccagtacaagagccggaactacagcaaaagcaagtttgaaatagaactgaatattatttaaatcaaaaaactttttccagtatgctaccactacagataaaatggctccaaactgaatagacacctgaaacatttttaaaaattctgtttcctccaaccccataagattcgctgtaaatcccatatgtgccgttgaagaaatcggaaggtattccgtaagcccttctacgatggcaataataattgctttgattaaatccatattcttttaaaaattaaaaagattaaaagatttaagaattaaaaaacagctcattagcttacatctttcaattcttaaattttttaatccttaaataaaattattatttattttctttttaagattgcgtacacttctattacaaaaccgattacgacaaacagaggcgctatcctgattcttctgatagaaaagatatcgtcattccatgagttcggatcaaattttccatctaccgtattagcatcaggccccatcatcagtagaaatcctacgacaataaatgccagccctatcagcatccatttgaaattctgctgcccgaaatagaaagcgttttcctgtggtacttctgcttcacgtccaaagtctgaagcggaaaatttatttgtttttttgctcattattaagagtaatataaatcgtcaacgtttgattttaagaatctccatgtagcgaaaattgtacttaagacagaaataaaaattcctactccaagcaccaggatgatcaaccagaaatattgattgttgtcctgtacaaaggcagagccaatctggcttgtgaaataataccagactcctccaagagcaagaagacctattacagagccgatagctcctaagataatagcttccacaatgaaaggtttaaggataaatcttcttttcgcccccaccaactgcattgttttaataataaatctcttcgagaatattttcagacggattgagttgttgattaatacaacggccaatatcaggaacaaaattgaaaatcctaggatccattttaagattctgctcaggttattgtacacatccaccatcaaagtgctgtcattcttaacatcaacaattcccggaacggacttgatctctttaatggcttcatcaattttggcaggatctacgaattccggttttaaagcaacttcaatagaagaagggaaaatattttcctcgaacaatgcatcactgtcgattcccatacttttcttggcttcttttgccgccatatctcttgaaatataggttgctttttttacaggagctaataactgtacctttttaaaagtttcttcctcaagttttgcaatttttacagaatctttagcatcatagttttcatcaaaataggcgttcaccaccaattgttctttgatatagtcagaatacttctgggcattgatcagaataagccccattaaccctaacaaaaataacactaaggcaatacttatcactactgtaatattgctggaccgaagccttttcttattaaattcatctacagatttagccattaatattaaaatttttggctaaaatagaaaaaaacttccgaaatttgggacgaaataaagaaaatcattgttaataaaatcataaaaaactttgagtgtaaaagcaaaaaaacatctggggcagcacttcctgacagatgaaaacatcgcaaggaaaatcgtagaaggccttagttttgagaactataataatatcatggaagtgggtcccggaatgggcgttcttactaaatatcttcttgaaaaggaacagaacatctaccttgcagaaatcgatacggaatctatcgaatacctgaaaaacaattatacaaaggttacagaagaaacttttgtcggagatttcctgaagcaggatttcaacttcattaaggaggatcagattgccatcatcggtaatttcccttataatatttcttcccagattttgtttcagattgtggatcattatcagctgattccggaaatggtaggaatgttccagaaagaggtagcggaaagaaccgctgccgttccgagaactaaagaatatggtattctttcagttctggtacaggcctattatgatgtatcctatatgtttacggtacatgagaatgtcttcaatccgccgccaaaggtaaagtcaggagtcatcagacttacaagaaatccgaaggaaggccttgcagggaacgaagttctttttaaacagattgtaaaagcaggattcaatcaaaggagaaaaaagctttccaatgctttaaaaatattaaacattcctgaagctttaaaaggacatgaatttcttgacaaaagagctgaagagcttagtgttgcagattttatacactttgctaatctctggaaagaaaatcagtaaaagatattaaaagcttctaatagagaagctttttttgaatacaatattggcatataatctcttaaaaagcagaaagcctttcaagtacatttgaaaggctttctttatgttgcattatcaattttagtttctgttcttcagcatgatccatcctgaccagttcatctgagcttttgattttggatactcaaactggaacttataccagtatgttgctgtcggaagtctcttacctcctacggttccgtcccagataggattttcttttgagaacctgaacatttctactccgtatctgtcatatacagaacctgtaaagtttttaaagtctccaagagctttaagatccagtacatcattgattccgtcttcgtttggagtaataatattgttgatctgtaaagtaaagaattcaagagatccaacgcagtgtgtgcctactcttcttactaaaacagtatagtttgtattatctaaaaggttgctgaatacgttagaagcctgccatgtaataccaccatcaagagaatattccaaagtacttgatgtattgttcattggcggattttcagcagtgatggttactgttttcttgatgctttcataatttaaagcagtaacaaaaggagtagctgctcccattactttagcttcaaagacttttttacagataccgttatcaacttccacactgtagatcccccattgggttacatcaattttctgtgttgtagcccctgtactccaaaggtatttgaaaccttgtcctgctcctgcatcaagggttacagtatctcctacacacatttcaacatcttttaatggtgaagtgatttccggcgtaacttcaattcttatggttgcagggttcagagatttacatccttttgttccaattgcatatactgtaaatgttgtcgtctgatatagagtaaccgtctgcatattaccagttcccatgaaattgctccacaggtaggtatctcctccttcagcagtaagggttacagattctcccggacagatttttattctggaagcttttactttcgctgtaggcgtaacttctttcagtaatttcaattcaactattttactacagaatcctccgttggaaacaagtacatacagaatctgtccatcattaccattataattcaatggcgtctgaatataattattattctgggcaactgcatccgcctggttttcgtaaaacttaaagatggctcccggtgtcgggcttatcgtggatgtaattgtacttaggtcaaaagtagtaatatccggtgtggtacacagcagcaatgtagcatcctgagcctgaggagttgttcctccgtgaatttctattgatgcttttcccggacatgggttaccaggaacacttacttcaattgtataggtacctggctgtattgctgtaatggtattggtagtggcatttggtaccggtgcaccattataataccattggtaaacaaggttagggtcacttacagaagctgtaattacctgaggtacattatcacatacattgatatctgaaggtaattttgttcctgctgaatctaaaagatctactccaatattaaaagatcctccttcaaggaatactgcagagtcataactgtggtcactgtaatcggcaattaccattttgaagtgatattcctgccctgcgactaccgttgctgttgctgttaaaggaattgttcttccttgaaaatttgtttcaatattcgctgtattgtaccctccaaaatactgttcgtttactgcaccacagctggatccgattgccgggtggatatttgtaatacttaccggtcctgcaccaccaggtagtacagccatattcacataaggtccgcctgaagtaggtctcaataatatagcaaaagcatcagcaaacgtacaagggaatgaaccggtgtattcttcagacgcaatcagataattaaatttaatctgagaggttgtaggaacaaagtcaaattccagaagaacagcatcgttcaacctgttttccactactccgattacctgtgcaagatcagggtctgaacctccaccattaatatcactaagcgtattcccttcaagaccgttccctgcctttcttgcaaatcctgtggaaagaataagaccatccttaaaaggaaaattggtagtagctttatgaaaatatccccatgctctgtcagcatcactggcagcatgattaggagtaatctttacattggttacgttcggagtaagacaagtattggttcctgatgagatcaatacatctttaaccattttatcaatagtgtagctactttcagcatactgcggagcgttcacatcaataaaagcgcctgctcttcttgacagtgctgtactgggttcctttacactctttctgggtaatggggtctgggaaaataaaaaagtcgagatgactaaaaaaaataaacaaagcggtagatatcttctcataatatttttgtttcaacaaatttaatttttttttaaatatctcatatacatatttacattttttacagcaaaaaatcaaaataagatcgttttagagtaaattttcgttaatcaatccctatccggacaaaccataaattgtgtggcagtattgttttaacatatttgccatctatttcaaataattcacgaaacacggtacaagttccctttaaaagcaacaaaatctctcattgctgagagattttgttgcttattttttattttgaaaatatctagtttctgtttttgagaagaatccatcctgagcgctgttccagttttttactggcagggttttcccactgtaccctgtaccaatatgttcctgtaggaagattgattccttttaaagatcccctccagataacatcacccttaccagctttgaatacctccgcaccgtatctgtcaaagatagaagctgcaaaatctttgtaaccgcttattccggagaaatctatagtatcattgatgccatccatattaggtgtaatagcattgctgatgatgaatgtaaaataatccagtgaagtaccgcatttagcccctttcacccttaccattacagaatacatggtattattcaaaactcctgtaaatacatttgatggctgccatgtcaatccaccgtctatagaatattccagaatgccgcctgtaggattacttgccgtaagcgtgagaatatgattatcataaacaatattcgtaaactgtggcaggtcaggattgatcagctgtgcagagaaagttttggaacaaactccattgctgattgtcacagaatacgttccgggaatattagttgttatggtttgcgtggttgccccagtgctccatacataagtatagtttggccctgaaccggcatccagagttcctttatcccctgcacatacaaatacatcttttaaagtagaaacgattgcaggaactacctgaatggtaactttagccggatcaacagaactacatccgtttccacccaatgcatatactgaatattctattgttgctgtaggcgtaacaatctgcgtatttccatttccggtaaggcctacccagttataagtaatacctcccgaagctgttaatgttacagattcaccttcacatatttttaatttagatgctgtaagacctgctattggcggacctacctcaaccgtcacactggccggtgttgcagaaatacatccattagctccaacggcaaatactgtatatactgtagttgtagtaggcgaaaccacctgagtatttccatttccggtaagaccattcccccagttataggttacccccccggatgctgttaatgtcacagattcaccaacgcagatacggggttgtgatgaaaccagtgcagcaaccggctgtactttatcttcctgtacggttactgtagacgtaaaagtacaggtcaggtttcctggttgtgagacattcgtaaccgttaaagtatacgttccgccagcgcttacaacaggggtcagtgtatttcctccggatacaatagttcctccggtagttgtccaggcaatggtagatcctgcaggcactacagatgctgaagcattgatagttatctgaggatttgtacaggtaattgtttgcggagcagcaattgtaagcgtagtctgagctgtgcttaataactgcaatgatactacgtaactacaccctccgttgcttacgagtacgtaaatagtctggcttcctcccggcggtgtataagctgtaggtgttacaataaagtttccgttagcagcaatggcatcagcctgattgacatagtaagtaaaagtaactcctgctgtagtggtgatctgaggctgggcttctataagattataagtcaatcccggctggtaacatttatgtaatgttgcattctgtgctgtaaaaggttctgaaacttcgattgttatactcgcgggattttgagatgcacaaccgttagctcctactgctgttacggtataagtagttgtcacggtaggtgaaacaacctgagtattaccatttcctgtaaggccattaccccagttataggtagccccgcctgaagcggtaagtgtcgtggaatctcctttacagatttttattttgcttgccgtaagaccagtaacaggtggagcgctgtttcctgtcacggttacagttcctactgctgtacagctgatatttcctggctgatatacttttgtaatggttaaggtataagttcccggagcattaataacaggattcagggtagttcctcctgaaacaatatttcctccggtagtggtccagttaaatgttgcacccgcaggataaacggaggctgatgcatccagagtagtctgagagttgttacaggtaagaactgccggcggtgcaatggtaggtaccatctgtggagcttttaccagttgaagttgtgccacttttgcacagaaaccggttgctactctcacatataccgtacctcctgcactcgaataagcggtaggattgggaattgtgtttgcgtttcctgcattagcatctgccaatgtggtatagtatgtaaacacagctcccggagtggtacttattgaagcctgtgctgatgttaaattaaaagttgcatttcccgcagcataacaggctgtcagtgtggcattctgtacggtaggagatgttccgccaactaccgtaatggtagcttctcccggacaggtgttaccctgaataaaaactttaacagtatacacacctggcgctgtcgctgtataacttgcgccggtagcccccggaatcggattggctcccagataccattgatatgttatattggggccctgcacagaagctgtaaaagtctgtggtgtattatcacacatattaacagatgaaggcaactgtactcccgccggatccagaatcttcactccgatatcaaatgatcctgcttcaagaaataccgcagaatcaaaattgggatcctgatagtcagcaaggacaattttaaaatgataagtttcccctggaattaccgttgcatgagcagtcaatggaatagtacgtccattaaagttggtctcgatctgagcattattggtccctccataataggcttcattcttaggtccgcaattttggtactgcggatgaatattggtaacacttacaggtcctgctcctcccgggagcactgcaagattggtataagtaggatcggacgctttttttaacagcaaagcaaaaccgtcggtgatggtacatggaaagtttagctgatattctttagaagcgaataaatatctgaaagtaatttcagtagaagcagctacaaaatcaaattctatagatgttgcattggtaaggttattattactgattcccaaagcgtttgccaggtctacatctcctccagttcccagatcatcacttaaagttccctggaaaacatttcccgctttaccggcatatcctgtggaaaggataatccctttactgaaaggaaagttggtatttgatttattaaaatatccccagcttcggttctgattacttgcagaaaggtttggagatactgttacattacttacacttgagctggtacaggtagttcctcctgatataagaacatcgttgatcagctgggttataggatagccggattccggatagcttggtgcatttacatctataaatacaccggctctcaaagaagcagccttaggttttgcagcaatttctacccttcctttattctgagccagaataaaatttcccatgaaagctaaaaataacgctaaaaataaatttcctctcctcctatttaacattttatattattttaaacaaaaatactattttttttgattgaaattcaagttaacacaatttacattattactaacgcaaatttatttatattagaatatcaactctgtttattttaaaataataaaaaaagactgacaaaattgtcagtctttcagttaatagtttaattattctatatttttaagcaatatccatcctgttttcacagtaagttccttacttgcaggatcttcaaaggttacctgataccagtacgttgaagtaggaagctttttgccctggaagtatccgtcccaatatggtctgattttctctgctttgaagacttctcttccatagcggtcgaaaacctgtccgctgaaatccttatagttgacaactccgctgaaatcaataatatcattaatattatccccgtttggagtgattacatttttcattacgaaggtaaaaaattcaaggaaacctacacagcttgtatatttaactctaaccctgatcgcaatgattttatttttaggcacattgttaaatatatttgaagactgccatgtaactccgttatctactgaatattccagaataccattacttggattacttgctgtaatgatcatggttccggtttcattataatctacttttatgacttcagggattacggctttaatcacttcagttttgaactcttttgaacaaactccgttactgatcgttaccgaatatactcccggagtacctactgtaatgctctgacttgtttcgccagaactccactgataggtatatcccggtcctgaacctgcatcaaggataattttatcaccctgacagatatgacctcctttcagatttgaaacaatagcaggaactacttcaattgtaatacgtgcaggctgaagagatttacacccttgcgctccgattgcatatacagtatacgttgtggtctgagttggacttacagttcttattcctcccgtagtcgcaacagcatcaccccattcataggtcactccgccggttgcagttaataatacagattcaccggcacagatctttaatcttggagccgtcagcacagcggttggtgtttcttctttccttaaggttaaagttgcaatcttactacagaaagctccattggaaaccaacacatataatatttgtccatccgtacctgtataattggtcagattcgtgatatagctgttattttgagcctgtgcatcagcctgattggcatagaaacggaataccgctccctgcgttgtactgatgagaggtttagcagtttccagattaaacgtagtcaatgaaggggtcgtacagagcttaagttcagcattttgtacggtaggacttgttcctccaatgattgtaatggttgcttcactaggacactgatttcccggaaccattacttttaccgtataaactcccgcctgggtagctacatatatagcactggttgctcccggaatggccactccgtctttataccactgataagtcattcccggaatcggggctacctgggctttaagctgttttggtgtattgtcacacatattgatgcttcccggtaaaaccactcctgtttcatctacgatcttaattccaacgtcaaaagatcctccttccaggaatacagctgagtcgtgagtagagtcctttgcatctgccagtaccattttgaaatggtaagtctgccctgggattacctctgcaacagccgttaaaggtgttgttcttccgaaataattaataagcaggtgcgggtttgccaatcctccaaaataagcagcattaataggtccgcaagtaaatccgtttcctgcaggaacgatattggttgcacttacaggaccagcagttccaggtaataccgcaagattggtataagtaggatctcctactttcttcagcaacagtgcaaaagcatcagaataaccgaggcaagggtaatttgaagtatactcatcagaagcgaatatgtagttaaattttacctgattggaattcggaacgaaatcaaattcaagggctaccgcatccgttaagctaacattggctccggtagctgctacaaggtctgcatcactccctgttcctactgattgtcctacagctgctacatagctgttacctgcttcagaagcataccctgtagtgagcacaatcccatctgtaaaggggaaattggttgtccctttatgaaaatatccccagaatctgttgttgttggtcacatcatgattaggagatacggtaacattcgtaacgttggctgttgtacagttggtaccaccattgatcaaaatattctttaccagctgctccggagtatagtttgaaggggtataaggaggtacattcacgtcaatgaatgctcctgccctgaggctggctgcagaaggctttatcttttctgattttctgacaggtctcgtttgagaaaacgcagaaacagaaatcaataaaagagaaaaaaggaaaaaatagttttttagtctataaattaacattttaatttcatttgttcaaatgtagcaaaaataattatatcaaattagcctttaactctagtatttcataaacagacagctaaatccacaacatttttttcttattgttacattttcttcaaatcataaaaaacaaaaaccatatcataaaaaaacagatcaatagtattgatctgtttatgttttaacggttattcttccgtctgtttatcatcttttttcagctgatcaatttcattctgcaactgggatataatatctttcaaagcttttatttcgttcttgtttgagcttacattacttttcagcattacatttttcgctctttcattgtgatcttcttcatcttcttcctcattgatctcctcaatatcttcctgaatgtcttcgatatcttcattaatctcttcaatgtcttcactgatttcttcgatatcctcgctgatctcttcaatatcttcctgaatatcttcaatatcttcgctgatctcttcaatatcctcctggatatcttcaattttctcatgactcttgttcacggacatctgaatgaagattgccagataaatagcttccagagaaagtactgtcgtaagaatgagaagcattttatcaaaattgacaatattcaacatcggaagcacaaacgaagttataaacagtaatgtatgtacaatcagggactggatagaccctatccatgatgtaatcttatctgctattttttcaagaacttctgttttttcgttatattttttcatcgttatatgttttacaacagttcctttgttactcctaatccaaacaatgcaaaatcatattttgccggatctttctcatcaaattttctgatggcaatatccagttcttctaccgttttccagtcgttctgggttctggaaaccaatcccagctttctggaaatatttccggtatgtacatccagaggaatggaaaggtttttctgatctatattttcccagattccaaaatctacaccacgtttatctttgcgtaccatccatctcaaaaacataataatccttttggcggaagaatttttataaggtgagctgatgtgtttatggcttctgtgcttttctgtttctaaaaatccgcttctgaacctttctatggcatgcaaaaagttattctctgtttcttttatttcaaataagctttccaggctttcattttctttataaatcctgttgaactgtctgatgaaataggaaaagtcctgtccgttgaaagttctgtgaatgcttttatccagaatactttccagatctttttctgaataattcatcacaaaatcatagggagaattccccataatatcaagcattttgtccgcagaattaatgatcgactttctgtttccccaggagatcgtagctgccagaaaacctgcaatttcaatatcctgctttaaagaaaaacgatgtggaatctgtatcgggtcattttcaataaaatcgggagcgttatactgatctgccttttcattgagaaaatctcttagttcttcaaatttcagcatattcatttaaatctttacactttccaatgcttttggcaggaatgtgttgggaaaaatttctcttgcttcatcggtaaatacggtaagatctccgtatctgttggaaaagtgtcctaaaatcaactttccaacctgagctttctgagcaattgtagctgcttccaaagctgtagtgtggcctgtataatccgccatttccttcaggtcgtgtaaaaaagtggattcatgatataaaactgttacatttttgataatcggaattacactttcaagatagcgggtatcactacagaatgcataggatactgatggagccggatcaacagtcagaatctcatttttaagaacgtaaccgtcactcagtacaaagtccttccctgctttgatattatgataatcgcaggtttcaatttcgctgtatttagcaatctctttcatattgagatgcctgtctttcggtttttctttaaaaaggtagccgttacagtaaatcctgtgatccaaagggatagtatatacttctatcctgttgtcttcatatattttttcagaataatctttatccagctcatggtaaaccacttcaaaaccgcgatgggtttctgtaatctgaaaaatggtttccagcatctttttaattcctttcggaccataaacgtgcaatgggttttctcttcccaaaagacggaaagaagcaataagccccggcagtccgaaacagtggtcgccatgaagatgggaaataaagatatgattgatttttgaaaatctcgctttcgcttttctcagctgcacctgcgtaccttctccacaatcgataagaaagagtctttcctccatttccagcagctgtgccgtgggtgatgtgttgatggttggaatcgctgaattaaagcctaatattgttaaataagtactcaaatcaataatttatggtaacaaatgtacaacagaaaaaccaaatggacgttttgccctgatatttaaacttaatcagtcacttttaaaaaatccataaataaatccaatgcctgtttacggtggctgattttatttttgtctgcaggatccatttctgcaaaggttctttcatatccttcaggaacaaaaatcggatcatatccgaatcctttaaatcctttgttttctgtgagtaaatttccatgaaccctgccctcaaaatattgagccccgttttcatcatagtagcaaagaactgtcacaaaataagctttcctgttttcaattccctgcatttcttccaatactttttcgatattttttgcaaagtcatgatctccggcataacgggcagagaaaatcccgggtcttccatccaaagactctacaaccagaccgctgtcatcccccagacttggaatgcctgttttttcaaagcaatatttggccttgatcagggcattggcatggaaagaatctccatcttccacaatttcttcgtgaatattataatcggtaagacttttcacaacgcagccacttcccaggatctgctggatttcttcttttttatgttcgttgtgggtagctactaataattccatttctatattcattttcaattttactttttaatcaggttacctacatttcggcataatgcactttatactttttcataaaaagataatagaataaagaaaaaagtacaattccaacagctaatacaagccattctgaaatatgaaggacctttgcaaaactctcatctttaccgtaaagcaccaataaagacagggttaaattattaaatgcatgcagcagtatcggcaacagcaaagattttgttttatgatacaccagtcccagcacacagcccagcattactgcactgatgaactgccatggatttccgtgaacaaccccaaaaataatggaggcgtacaaaatggctctccagggtttcactcccttattgatcaatcctttctgaataattccccggaatataatttcttcaaaaaccggagccataatcaccgtcatgataatcatcacaaccggattatcagttaattgactcatcagctgggtaaaatattcataaaaatccccgaaaaatggtcccgttgtaggaatctgggcagcaacaaactcagaaataaacatcatcccggtcatcattggaaagatcagaagataggtagaaaaattaaccgatgataaattgaagttaagcttcttttgcgtggtacgtcttacgataagaaaatcaaaaaaggcaattgcagtaaggaatcccacggaatttgccaccatcagaaaccagtctttcagttcaatattttccctgaaaacaactttccaaaaagtgctgaataaagaaacagccattgttcctacgaataatccaatcaccaaaacaacaccgccaatccatgtaaaagtaaacttcggatatttgctattttccatcctttctctgtaaaagtttatgagaaacaaagataatttttttgactgccacaggcaactaaaaaaggactttcttatgtatttgatgatgttataaagtccatttgtaaaccgtttccaaactcttctacccgcctacgctctatagtgatcaacattgtcttcatttaaatttgaaaacctcataaaaaatcacgatttttgcaacttcaaaatacgatatgtcagacttaatcaaagaaatacaaaaaagaaagaccttcgggatcatttcccacccggatgccggaaaaacaacccttacagaaaagttacttcttttcgggggtgctattcaggaagcgggtgcggtaaaatccaacaaaataaaaaaaggagccacctccgacttcatggaaattgaaagacagagaggaatctcagtagcaacttccgtattggcttttgaatacagagaccataaaatcaacattctcgatacgccgggtcacaaagactttgctgaggatacctacagaacattaactgccgtagattccgtaatcgttgttattgacgttgcaaaaggggttgaggaacagactgaaaaactggttcaggtttgcagaatgagaaacattccgatgcttgttttcattaataaacttgaccgtgagggtaaagatgccttcgatctgttagacgaagtagaacagaaattaggattaacagtttgtccgctttctctgccaattggtatgggaagtgatttccagggaatttataacatctgggaaaacaatattcagttattcctcgaagagaaaaaacagaaggttggtgattccattaagtttgatgatatcaatgatacttctattgacgaggttatcggtgaaaaagcggctagtactttaagagaagagcttgacctgatccagtctgtatatcctgaattcaatcgtgatgattatatgaggggtgatcttcagcctgtatttttcggttcggctttgaataactttggtgtacgtgaattattagatgctttcattgatatcgctccgatgccacagccgaaagaaagtgatacccgtctggtaaaaccggaagaaaacactttcacaggattcgttttcaaaatccatgcgaatatggatcctaagcacagagacagacttgctttcgtaaagattgtttccgggacttttaaaagaaatgaaaattatttactggtaagagaaggtaaaaaaatgaagttctcctctcctaacgcattctttgcagataaaaaagaagtggtggaagaaagtttccctggtgatattgttggtttgcatgatacgggaagtttcagaatcggagatacactgacaggtggagaaaaattaaacttcaaaggtattccaagcttctctcctgaacatttccgttatatcaacaataatgatccgttaaaagccaagcagctggcaaaaggtattgatcagttgatggatgaaggagttgcccagctgtttacccttgaaatgaatggcagaaagatcatcggaacagtaggagcacttcagtatgaagttattcaataccgtcttgaacatgaatatggcgcgaaatgtacttatgaaccattatccatgcataaagcatgctgggtagaagctgatgaaaaatctgaagagttcaaggaatttgcaagattaaagcagagattcctggcaagagacaaatacaatcaactggtattccttgctgactcatctttcaccattcacatgacgcaggagaagttcccgaatgtgaaactgcacttcatcagtgagtttaaagatattaaataaaggtaaaatcgcgaaaaggcgaaattgtttaaatatagatccgcagagaatttctgcggattttttataatatatcatatgaaaccaccccggcaaaaattcttcgaatttttgccacccctccggaggatgggaatttttagattttccaacttatatttggtaaaatgacaaagtgtacggataaaactcagcgttccatatcttattccgaaggaatctaatccatgacaataaagctctgtgattaaatgattccttcgagaacataaatactgttcttacaacattaaaacgcagaaaacattttgtaaatcttttgtaaaacaaatacaaaacactgaaaatacaacagttataactttaccagcataatacagtctatttacaactgttacaagaacttcacttctaattttacttcatcaaaaaaataatcttatgaaaaagttcatattacttgttgctgtatcaggcactttcattatgtgtaaaaaaggcgaagctgcccaggataagatcaatgaagcaatccacacagcagacagcgctgcgacagtggctacggaaactgttgacaatgtcagcaaaacagcagataaggttctcgattctgcgagtattaaaataaaagattttgaaaataccaaaaatgacatccagcaaaaaatagagaacacctccaaaatggtagattctttatctgagaaaatagctgcaacaaaactggaatcaaaagttgaaaaaacagattctgcagaaaaaaaatctgaaaaaattgctgtaaaagctcctgctccgaaggttattaaagaaaccaaaatcatttacaaagaaaagcccaaaaatgacagctatgaattgaatatggccaaagataaaatggtaaaagcagggtatcttgatataaaagcagagaatgcagaaacggtgaaggaaatcatcagggatgaagcctataaaaacaacgcttacatcaaaaatgaaaatctttcttatgtggaatccgcaagtcctggcggggaaaatcaaaaagtttacagccttgatattaaagttcctatgcagtactttgatggcttaataaatgctatcagcagcaatatcggggatattgaaacaaaagatattcaggtttcgggaagccagtatgcagatcataccatctgtacgatcaatgtaactatcagcaatcagcccaaagtggaaaaagaacctgagacctttggtggcaaatcgttagctgccattgaatcaggctggaatgttattacttccatattcctgtttatcctgcctttatggcctttgtttcttattgccggcactggatattatttctataaaaaaaagaataaaaacaccgctgacaatgactctcattagatttttaatttttttttaatgagatttggaactgatgttcgattcttatgtttaattttatcaaatattcaacggaagtattgtttattagaaaaattactgctaactttaagtatagtcaaagtaaatgaatcttcgatacagacgaagttctcaataaaaacggaaattttaatttcatatattaatattttgtgatttggtgtaaaagtaaggctctcaatctgagagccttatttgtttttatttcatgttcactactttatctacgataaattttgtgtttcctctccacggaagagcgccgttgtactctttgtaatgcagatcaaaggttttaccgctattggtttccagttgtttgaaaacttcaggatcatctacagaaaactcaaactcatagcttgtaatggttcctgttttccctcttccaaaaccttcctgaatcagttttccttcataggttttgaagatatagcctttcttcatggcataattcaggtagccggattttactccttccccaaaaacgaaataatacttataccatacaaatactcccagtaacagcagtacgacaccgagggtgatccacaaagattttttcatagtagtgtgtttataaaatgttattttgcgatgcttcttgagatcacgattttctggatttcagaagttccttcatagatctgagtgattttcgcatctctcattaatctttctacgtgatattcttttacgtatccgtatccaccgtgaatctgtactgcctcaatagtagtatccattgctacctgagaagcgtatagttttgccattgctccgctttcagaaatatcttttcctgcatctttttcacaagctgctttgaaacacaacattcttgcagcagtgatctgagtagccatatcagccagtttgaatgcgatcgcctggtggttgatgatttcagttttgaaagcttttcttgttttagcatattttaatgccagttcgtaagctcctgaagcaatacctaaagcctgggaagcaataccaattcttcctccgttcagtacagccatcgcaaagttgaatccgaatccgtcttcaccgattctgttctctttcggaacttttacgttattaaagatcaaagaatgcgtatcacttcctctgattcctaatttatcttcttttggtccaacctcaaaaccttcccatcctctttctacgatgaaagcattgatccctttatgctttttctcaggatctgtctgcgcaattacaatataatagctagctgtaccaccgtttgtgatccagtttttgataccatttaaaagatagtaatctcctttgtcttcagcagttgttttctgagaagttgcgtcagaacctgcttccggctcagataatgcaaatgctccgattacctgtccgctcgccagtggagtaagatattttactttttgctcttcagaagcaaatttttcaagaccggcacaaaccaatgaattgtttacagacattacaacagctgcagaagcgtccacttttgcaatttcctccatggcaagcacgtaagaaacgctgtccatacctgcacctccgtattttggatctaccatcattcctaaaagtcccatttctcccattttcttcacctgctctgcagggaatttctggtcacggtctctttcaatcactccaggtaaaagttcgttctgtgcaaagtctcttgctgcctgctgaatcatcagctgttcttccgataaattaaagtccataaaaaaaataattagatagccgtaaatttacactttttaagcaaatctgaaaaaataaattaaaagcaggaaaatggcacagaaaaagcaattttggagaggtttaaagatctgagatctatgtttcgggattcaaaagaataagatttcagatttaaacagaaataatacaggaattgtggagttatataaaagaccaattgaagagattaaccttttattcaggctttcaaagctgcttttgatatcaattgttatggcaagcatttaagtaatttctaattattggcttcagatgttttcaattaaaaaaaatgcttatatttaaatttctttataaattacgtaaaaaatcatgacgatcaagagattattcgatattccacactacgctttggagaaatatcctaaaacggatatgttcgtaacaaagtatcatggtgaatggaaaaaaacttctacgcaggagtttattaatgagggaaataagatatcaagagggttgttgaaactgggcataaaacctggtgacaagatcgctttgattactacaaattcccgcactgaatgggcaattatggatttcgggatttctcagatcggtgtcgtttcagtaccggtttatccaagtatttctccggaagattatgaattcatcttcaacaatgcagaaattcagtactgttttgtttctgataaggagctattgaataaggtcatgaaagtaaaacacaacattccgagtttacagggaatttttacttttgataacatcagcggcgcggccaactggagagagattctggatctgggtcaggatgaatctacacaaattgaagtggatgatctttccaatgcaatcaatactgaagatctggcgacgatcatttatacttccggaaccaccggaagaccgaaaggggtaatgcttactcacaataatattgtttccaacatactgggagctattccgaggattcccaaaaagagaagtttcgattacaaagaagcgagagcattaagtttccttccgatctgtcatatttttgaaagaatgctgttctatctttatcagtacaacggtttttccctttattttgcggaaagcattgagaaaatgggtgaaaacgtaaaagaagtaaagccgcattacatgactgtagtaccaagactggtagaaaaagtatatgataaaatttacaatacaggatcttctgccggaggcctgaaatcaaaaatattcttctgggcactgaatttaatcagtaaaaagaaaaccatttcaaagccatccggacttcaggaaatcattgctgataaactggtattttccaaatggagagaaggtttaggtggcgaaatcgtgactttggtttctgggtctgcagccttatctacaagactcaacctaattttccagaatgcaggaattcctattctggaaggttatggtttaacagaaacttctcctgtaatttctgtaaacagctttgataagatgaaggtaggaaccgtaggagttccattggataatctgaaagtaaaaatacaggaagacggtgaaattaccgttaaagggccatctgtattcaaaggatatttccagaatgaagaaatgaccagagaagccttcacagaggatgggtacttcaaaaccggagatatcggacatatagacagtgacggatttttacagatcaccgaccgtaagaaggaaatgttcaaaacttccggtggaaaatatattgctccccagactattgaaaatttagcaaaagcttctaaattcattgagcagattatggtagtgggtgatggtgaaaaaatgccatgtgctttggtacaacctgatttcgaatttgcaaaaagctgggcgatgagaaacaatctgaacattggctctacaccggaagagattgcgaaaagccctgaactgaagcaaagaattgaaaaggaaatagaaggcatcaacgaacaccttggaaactgggagaaaatcaaaaaaattgagcttactcctgaagtatggagcattgaaagcggattgcttactccaacattaaaactgaaaagaaaagcagtaaaagagaagtttattgctttgtacaataagatgtatgatcaccatgattaaatacgatcaaccgcctcattttgaggcggtttttttataggttttggctaaagccaatggagagatcttatttttgattaaacggactaaagcccgttcctattgattcccatcattccgttttttaatcaattaaaacactatccctgtcattcagtaggaatccatgttatgttgaaagaagagccgggattctacggaatgacaaagactttgattaaattgtactgctatgtttagatcagttcagataaaaaaagctgcttcatttctgaaacagcttttgtatgttataaaatcaataattagaatttaattacagatttcattttttcgttttcttccattaccaactcgtcatcaacaagaattttcccagagtgctcatcaataatgattttctttctctgagcaatttccatctgcttttgtggaggaattgtgaagaaagatccttttggagctcctctttccaatcctactacagcaagaccgttgatagagtttgttctgattctgttgtaagaagccagtaatctctcatcaattttagctgcgaattctttagactgctcgattaaatactcttcttctttctgagtttcagagatcagcccatccaattcttctttcttgaatttcaagtggcttttcagatcgtcgatcttagcattcagttcgcttaaagtttcgtttttgtgagcaattttagctccgaattctttaattcttttttcagcaagctgaatttccagatcctggaattctatttctttccctaatgcttcaaactctttattgtttcttacattatcctgctgagatttgtatttctcaattaaagttttagcatggttaatcacttcatgctttgttttgatctgatcttcctgatctttgatatctgcatgaaatttttcagctcttttttcaagaccttcaatctcgatttcaagatcttcaacttcaattggcaattctcctctagtatttcggatttcatccaatcttgaatcaatgatctgtaaatcgtataaagctcttaatttttcttcaactgaaatatcgttggtttttgccatatttaaatgaaataatttactgggtttgttttttcaatagattttgaaattgcaaatgtactaaatttttgtgataaaatttcaaataattgttgagtaacaaattgttcagattcataatgtcctatatcacagatcagcattttagactctgccagaaaataatcatggtatttaagatctccggtaaggtaagcatcacattttttggcggctgcagatcgtatcccactggctcctgaaccacccaggacccctactcttttgatttttttattgttgaaagccgaatgttttatgacttcaagtccaaacttttctttcacaaacccaagaaaatccttttcatccatttcttcttccaggtctccatacattcccagtccggcatgatgatttttattatccagactgtaaatctgatgagctacttcctcataagggtgtgcagctttcatcgctcctacaatctgtccctgtttaaagtcttcaaaaattacagaaaccatgtcttcatcagcattttcacgaattccctgctgtcctgaaaatggattggatccttctaccggtctgaatgttccgttgccattcactgtaaaactgcattcgtcataaaatccaatgcttcctgcacctgctgaaaacatagcttcttttactttttctgaatattctttgggaacaaagaccgtcagctgttttaaattattttcctttggctgaagaattttcatattctttagtcccagctggctgcatattccatgatttaccccaaagaaatcattatcaaatgcagtatgaacggcatagatcgctactttattttcaatagcctttaatacggctctttccacatagttttttcccgtcagggattttaatcctgaaaatataattggatgaaaacatacaatcagattacagtttctcgcaacagcctcatctactacattctccagcgcatcatggcataccagaatccctgatacatctcggtcataaacaccacacaacaatcctacattatcaaaatcttctgcctgcctgatacttatttcctcttcaatctttgcgattacagtttttaatttcattactttatattttacagttacagcgaagatattaattttactaaaaatccggaaaaatttctgcagcaataaaaaaaccggctttcacgaccggtttcattaatataaaaaagaataaaaaaggctgttaatctttgaaaagtgatactcttgtaaaggattctattactacaccgcagtttatatcagactccataaaaagctgatagccttttccgggatccagactcgcagggtctgcaatagtatagaaataaaaggtaagaatgttacctgctccattggaaccgcttggaaccaactggatagagttaatttcaaaaccggaatcaggatttttaaaggtggcctttacagatcctgaagaattagatccgggagtaattgttgcaattaccctccatacgtggacctgaccgttaatttcattttccctccatttccctgtagccgagacataaatattgcttgtaactccaggaaatggaacagttgtttccggccagcttgtagtagggcttggagcaaagaccagcggtgtggcataaagtacctgttgtcttgggccatagccacttcctgatgcacttaaactgaatgagggttttacatttgcgtttccagaatttattttaacgacaccgtcgttaccagcctgagaagatgtgggaacaaaaagctgtctccagagggtaccatcccagtactggaaattattcgttgtcgtattaaaaatgagggttcctgcagtaaggttagcattaacaacacctgcaggaggtactgtggaagcattattatcagccaggtaagtatcccggtcagtgtctgtaagacgaggaatgagaattcctttttggtttgagactatatccagtactgcggcaccgtttggcgtagtagtattaatcccaacctgagcatacgtaaaactgcttatcaaaaacagcataaacaaggttaaaatttttctcatgatataaagcttttgtagattaaaattacaaacttggtctataaaaatgttaaaaaaaaaatttttatatgtcatattttattcgtattttactaaatataacacattgaaaaacatgtaattaagtgtaaataattcactttttaatgatagaaaattcattaacatttgcagaattcttttaacaatcatatatttaccctatactttacagaaattactaacttcgctgtgaaataaccctatagaaatggaaagagaacataatcttgttcctgaggacaaactttggaaaagatacctttaccggataatttaccgctccgatacaaagcttggaaaactcttcgacatcatattattgtctttaattcttgtaagtactgctattattatgatggaaagcgtacctaaacttgataaaagatttcattatactttcctgatccttgaatgggtaatctctattttcttcaccctggagtattctatgcggattgctgtagtaaaaaataaacgcaattatatattcagtttttttggaatcatagactttcttgctcttgtgcctttttacctcagctttttctttccggtcaccaaatatttcctgatcttcagaatgctgagaatgctgaggatattcaggattttcaatttacttgatttcatgaatgacggctacttaattgtgagggcattaaagaacagttccaggaaaatctacatattccttctgttcttaatcattttctccgttattgtaggctcgcttatgtttatggtggaaggtggaagagaaggctttgaaaccataccgcaatccatctactgggcagtggttactgtaactactgtaggatatggtgatgtatctcctattacgcctttaggaaagttttttgcggttgttctgatgctggcaggttattctattattgcagttcctaccggtattgtaacagcggagatgagaaacaaaagacagaacctggaaatggtatgtgaacggtgtggtaatgatgacattgatgatgatgcaaggtattgcaagaaatgtggcaagaaattagcttaacatttgatataagtaaaatttattcaccaaataccacaaaatcatggaaccgaaaaagaaaaacagaccgaatagcctagtacttattctttttgcactggtagtgctgatgatcgtcatttattttatcttagtaatgttcttccctactgtttttgatcttatgaataagggagacatacagccggtgcccaacaaatgataagtaataagttatgaggtaataattgatcataaatgatcatcaagataaaataaaagatgagtgaaatgtttcactcatcttttattgatcaatttaacttaaatcatcatcaataaaaaatgacgggtcatatgatccgccattttctttttatttaaatgattaattactttttaatcgctttaatggtctgcttggtaccgtctttcatttccagagttactaagtaaacaccttgcattagatccctcaaatggattgcagattcagggttcgcaatagttttcaccagtcttcctgtagtatctgttaccaatatatttttaacattcttgctatcagaaatatttaaaacatctgtaaacggattaggataaacctggatcgtattcttcgctacagcaacttcagatgttgcaaggttggcgttgttaatactaatatcatcgatatacagataatactggtcagaatctgaatatgcattaaatccaaagaaatatacgcctgttacaggaactgtaaatgtcacagattctgtatgagcaactccatcattgattgaaggataatctgctacagaacctgtcatcgctgctgcatccggtgaagttccgtaggctactttcaatttttcaacataggttgatgagttattaccatacttatagctgatcgtatactgtactcctgctgttaaattcagtccttgtgtaaaaaaccaggtattggcagcgctggaagagttataatgatacttcaatacattagtcgtgaatccctggctgtcagaaggtggatctgacgtttcccaattatttcctgttcccacattaacattcacggtacaacctggaagcgccggaatagtaacattttcaaaatctacagtataaggaagaccggtacttgaacataatgtcgtaaatgaagccgactcactccatacacttttactggtagcactacatgcagatctaacccatacataataagcagtagaagctgttaagctcggaatattataggtagtcgcagtaattcctgtgaaattaggtgtagttgtggatgtaggtgctgtattggttgtactataataaatatcatatccgttcgcaggtaccggagttgctcctgtccaggaaactgtagctccagccgcacttagattggaaatgactagtgcgctaggttcactacaagccggtgctacatctatattgatatcatccacatataatttattcatattagcatcagaataagcctggaatccaaaataataaacacctgtagaggtcggtgtgaagtttacaaaggtactggtagctgcactggtgacaatattcgggtgatctgctaatgtattagtcattgctgcacctgtagccgaagttccgtaagctacttttaacttttcagcgtacactactccttctgcatttgcatatttatatttgattctgtaggtaactcctgcggtaaggtttattccatttgtgaagaaccaggtatcggcactattggcataatcatatgaatactgaagtacatttcccgtaaatccttgagcatcaaggtcacctgtttcccacatattccctgagccgtcattaaccactgaggtacaattcggcagatcaggaggtgttatactttcaaaattcagagtatatggcactcctacagcaacgcaggatgtcataaatgtagccatttgggaccatgcacttttatctgtagcagtacatacagaacgtacccatacataataagtagttgccggtgtaagtgaaggcaggttggtacttaatcctgtgcttgatcctgaagctaccgtagaagcagttggatatgtgctggaaactgaatagtaatattcatatccaacacctggtgcagaagatggtgccgtccatgctatctgagctgaattagctgtaactgaagatgccgttaaagcagtaggggccaaacaggttggagccgatccaattaccactgtataatcatgggcttcaccatagcctcctgtattacaagggataggttgactggaataacgatctcctaccctcattctgtaagtaccaggagtaacggtagaaggaattgttataagtccggaagtaatattttctcctcctacaagagtactgcttgcagacgcagcaagctcaggagctgcatcatcaaaagttccgtcattattaaaatctatccagatgcgtacattctgattactgtaattgtgcttaacgctaaaatcataacttaaacctgcattcaggttgattgtcatagaagtgtaatctccgtatgcattcgtggagcatcccgtattcgaatgatcaaatccggcagccggaattttaaaagaatctatcatgtcccctccatcacagccactggcaaactgtggtgtacagtaactctgtgctgaggataaaaagccggttattaagaaaccaacaagtaaaaaatttctcatataaaaacagtattagttgatcaaatctagtgaaaatcagcaacaaaaaaaataatttatttataatataataacaaatgcaaattttccttcaacaaaagacaattccacccataaaaaaagactgctcaaattgagcagtccttttttttcatatcatttaaaagtcacttatcttttaattgctttaatggtttgcttagatccgtctttcatattcaaaacaaccagatataatccttctttcagatctctcaactgaagttcagaagaaggtttttcaatggttttcactactcttccggcagcatcaaccacagaagcagattttaccttagaagcatctgaaatattcagaacatctacaaatggattagggtaagctttgatttcattatttttcttttcaacctcagctgttgccaaccctgaacatccttgtgtaacagaaatactgtagttaccgattctggaagctgcatatcctgtaagcaatacataataagtagtacctgcaactccggtaaatgttaatgtaggagcattataaagagttactgcacaaccagtatcagcatatcctacccctgagctgttactgaaacatgtaagtgatccgcaagtaccggtatacaccctcagataagcatcatattgtgtaccgcaagcatcaatagtaataggaccgttttcagtagctgtaactgtataccaaacacctttataagaagcagtacttccagtacttccacatgttgaagcaggaagtgtttcatcgccagccaaagcattaactccctgaacagttccgttacaagctattgcaacagctgtatcacaagtatcattagccacagctgaaggagtagttacagcaatctgaaaattagacgttgtagtagctgtacttgaagttgagaatactcttacataataagtctgtcctacagtaagattttgtaacagtacattggaatttccatagtcgccggcaaaacaagtaacagcagttaaagaaccacaagttccggaataaacctgtgtagttgttgcattatcagaatacagcacatgtacaaggtgcgttgctgcagttgctgtaaaagaataccaaacatcatcattgatacccgatgtgctgcacgtaggagcagttacacctgaacttgaagtagcacttacagtagaaccgttcaatgcgtttacaaaagcatctgtactgctcactgtaagagatgttgcattggtacaatcatcatttacaggtggaggtggaggcgttccgatacagatattaaaactattggcatacaaagtagaaccatttgtattggaattgtatattcttacataataagtctgtcctggagtaagaccggaaagcggtgtatttactgttgttccgcatttaatgcttgttaacgcaccacatgtcccactgaacacctgtgtatacacactcgtagatgtagatgttccaacagcggtaacatttgaaagcattaccatatggtcagtacctgtagctgtaaatgagtaccacacatcatcgtccgctgttcctgtacatgggcttaccgccaatcctgaattagttgcactcagagttgttccggataccggtgaagcgcatgttagtgttgggctaacggatagtgcaacagcacctgaacactcatcattagcaggagctgcaggaagtgttcccatacagatattaaaggagtttgcatagaaacttgcgcctgaattagcatcataagtatatactctcacataataagtctgacccggagtaaggccagttaagttcgtaaagtttgtatttgaactgatacatgcagtacttaccagagttccgcaggcaccactaaatacctgagcatacaatgatgttgtagaaacattccctacagaaactatatttttcagctggaaagtatgacctgttgacgttgcggtaaatttataccaaacatcatcgtcagctgttcccgaacaagtacccagagaaactcctgaacttgttccccccaatgtagttcctgctgttacactaccacaacccatatcaggattaattgtgatcgcaactgcattagtacaatcatcattagccggcggtggcggtggtgtacttacacagatattgaaacttgcgttagccgttacagtagatgagtaagtatatactctgatatagtaagtctgacctggagtaaggccggtaacaatatttgtatcaggatccgaacacagtatacttgtcatagtagcacagtttcctgacaatacctggaaatacatatctgaaacacctgttgtacttccggtagaagctacattagacaatgctatcacatggcttgtagcagttgctgtgaatttaaaccaaacatcatcgtttggtgtaccggaacaagtaccagcagccatagattcggtggctcccaaagtattacccggagttgttgctgaacaagtcaaagaaggattcactgttaaatttacagctccggaacagtcatcatttgcaggagctgaaacagtagtagtaaacgttctttcagtacaacctgcagacacaacgccaccattataagctgtaacagtataataatattgcgttgtcgggctcaactgctgtgcagcggtaagcgtatatgtagtcacatttcctacatcaaaattatttaaaatattggatgaacccgcagaagttccgatacttagtctatatcctaaagcaccactcacagcagaccatgaaaaaggagttcgcaaaggcagaccggtttgcgccgcagtgggagcatttacagaagggcattctaatgttgacgttgtagtaaaagacctctcagtacatgcagcagaaattcctgtagaattagaagcatatactgtataataatattgagtgttaaaactcaaagaattcgttaaagtataggaggtaacatttcctacatcctgcatgttcatcacattggttgctccaggtgttgttccgatgctgatcttataagatgaagcagaacttgcagaagcccaagtgatggttggcaatacagaaacatttgttgctgcagctgcaggagcagaaacaaccggacaaacaggagcaacgggagcaagccccagcagatttgtcacagattttgttgttgttcttgttccgctaggaggtgaagaaggatccgggtttgttgaatcacttctgtaatacagggtagaattggaagcgcctgagaaagtatagaatctattggcagatgcagtatagtccggtgtattctcatcaacagcaatcaataaattatctgtattgttataagcaaaaggagttgtaaagtttacagtcacctcacctgcggaagcacttactgttccggaaaaaacctgagtcaaacctgaaacagaaacccagtctgtagttcccgaaaaagaggttttagtagtatgaccaatatatacaacccaatctacagattttgaaatatccgcattattgggaaggtaaaatttcaacccggtaatgttcccggctgcattggcattgatttcacttttcgtaaaaatctgctgtgtatagctgtaaccgtagttgacatcaattggcgcaactccgctctgactggttccactacccagcattatctgggcatttgtaatggaagctattaaaaataaacttaatagtagtaatttcttcataaaatagtaataataaaagttagggcggtaaatgtataaatattaatttaatttttaaaaaaaataccaaaaaatatcataaaattttaaataaaaacaaataaaaagagtataaaaataaaataaaatcaaacgtttatttaattttaatatttatttcgcaatatgttgaaaaacacaaaacaattgataatcaattatttaattactacacagcaaatatagacttcagaaaatttttctaattaacacaaaaacacattaattttttttcataaatactctcaatatgtaaacaaaaaaagagtgacctaagccactcttatacatcaatatgttattttttttatattctaattcaaataaaactcatatttattcaataactgaatttctttgatcaggtctccgttcagatcaaccgagtgcttcatagactgcacttcaatatgggaatcatcttcaaggtttttaataaaaaatttcagcttttgatttcctttattccgatccagaactgttctgaaaaaatcaagatcttcaggccttacatccattacatccattacaagcgatatactttttgcaaatctttcgaatgcttcctgaagctctataacatcaactacattaacgaagactcttccgtctttcacctgggcaaattttattttaaatataacaaatctctgaacctccagcttttctttcagcctcatataatctctgtcccccaatctgaatgaatatgacccggaatagtcttccagcgtaacaaaagcgactttctcaccacttctgaaaccatcctgaactctgtattccgtaattagaccggctacagtatactcttttcctccgccaccgttttctctttctttctgaagggttttccagtctttctttttctcttcaaacaattcctcctgcttgttggcaaaggcctgttccttataagcatccacttcatcgagattcaggaacaggaaatttccttttggttctgcttttttggtcacttcttctataacttcctcttcacctgccactacatcatctgaaacaatttccgtaagatccacagcatcgtccagggcatcctgctccaaaacaggtgcttcatctgtaactaccttgtcttcttcatttttctcaagaaccgctttcttggaaagctgcccctgcataaactgaaactgatatttaaattcatccagcggatgtgcagaaaggtagaaaccaataatctctttttctttattgagcttatgcatatttggccattcgggacatggtgcaagtttaggctgttcaatctgaacttcttccgcaaaatctgcaaataacgagtgttccatctcatttttactttcctggaagctttgtccgtatctgatcagtctttccaggtttgttttcccggccatatcaatatcaaaatactgacctctgtggaatgaatccagctcgtcaaatgcaccggcaagcaccaaactctccgctaccctcttgttcatctgggaaggtaaaattctttcaaaaaaatcgtaaatatttttgaatcttccgttttccctttctctggtgatcgcctcgctcggcccttcacctattcccttaatcgctcctagcccgaaacggatctgccctttttcgtttactgagaatttatattgagattcattaacatcgggacctaatacatctactcccatacttttacaatcctccataaacatagtaattgaatccgtattgttaatgttgttactcatcacactcgccatatattctgccgggtaattggcttttaaataagcggtctgataagcgataaaagcataacatgttgagtgagacttattgaaggcatattccgcaaaggctttccagtcattccagattttttccagtctctcctcattcagattgtttttgcgacctccttcaataaatttcggatacatcttattcagaacgtcaatctgctttttacccattgcttttcttagcgtatcggcctcacctttggtaaaattggccagcttctgggacaaaagcattacctgctcctgataaacggtaattccgtatgtttcttttaaatattcctccgtttccggtaagtcataaacgatttcttcaattccatgctttctgttgataaagtttggaatatacttaatagggcctgggcgatacaaggcattcatagcgataagatcggcaaaaaccgttggtttaagctctcgcatgtatttttgcatcccgggactttcatactggaaaatccctactgttcttccttctttaaataactgataggttttggcatcatcaagcggaataagatcgggatcaatatcaactccatgccttgctttcaccagttttaaagcgtctttaatgatcgtcagtgttctaagccccaggaagtccatcttcagaagacctgcactttctgctaccgagttatcaaactgagacacgaggatatcagcatcttttgcagcaatcgtcacaggaaccaggttgctcacatcttccggtgtgatgatcaccccacaggcatgaattccggtatttctgatacagccttccatctttttagcactggccagaactccgtgccgcgaatcatccggactctccagaacatatctcatttcatcaacgagcatctgctcttccggctttaatttatcatattttgctaaagcttttgcaatgttcattccgggtgtggaaggaatcagcttggcaatattattcgtatccggaatcggaacatccagtactcttccggcatctttaatggcagacttccctccaagtacagaataggtaatgatctgtgctacctggctctgtccgtatttttcaattacccatttgataaccctgtctcttccttcgtcatcaaagtcaatatcaatatcgggcatggataccctttccgggttcaggaacctctcaaaaaggaggtcgtatttaatagggtcaacattggtaattccgatacagtaagctactgcagaccctgcagcagaaccccttcccggaccaacccaaactcccattttacgggcttcattacagaaatcctgtacaataaggaagtatcccggataaccggtattagcgattacttcaagctcaaagtcaagacgctctttgatttcatctgagatttcatccataagccctgagtcaacatacctttttttcgccccttcataagtaagatgtgtcaaataagccatctctcctcttttccctccgtctacctcatcttctgcatggataaattcttcgggaatatcaaacttcggcagcagtacgtctctctttaaggtataaggtttaaatttcgccgtaaattcttcataagcatcaaatgcatcaggataagctaaaaaagcttcttttatttcatgtgaactcttgatataatattcacctgtagccagtccccttcttttaccaaacccttttcctataggtgttgtgagtttttcaccatctttgatacagcttacaatatcctggatattggcatcatctttattggtgtaaaaagtctcgttctgagctaaaattttgacattatatttatccgccagatataacagcacttcattcaaatgctcttcttcaggaagtttatgattttgaatctgtacataaaaatcatcttcaaaagtatctttccaccatttgaaaagctcctctcctttctgttcaccggtattcaagatcgcatcaggaatatcccccataattccggaagttaaagcaataactccttctttatattgggcaatcagttcacggcttacccttggaactccaaaatagaatcctttaagaaaaccaatactggaaagctttgccagatttttatacccgttaaaatcttttgccagaagcaccacctgcgttctcctgtcaggatcgtcttttgtaaactgcttttgctcgtaacggtctgaaatataaaattcacaacccacaacaggaataagcggttctgaaacaggttcttcttcattaaattcagttccgttttcttctgcttcctgttttttggcaagatattctttatgttttttcgctctgtctgcattagccccttccactgctgaaacaaacttaaaagctcccatcatatttccaagatccaccattccgacagccggaaagttttcatcagaagcttttttaatcagatcattgatgcttgaagtagctgtaagtgtggagaaaacactatggttatcaaaattgaaatatttacctaaatcaatttcatcaatgcttccaaaatcctgctgctttttcttattatgaaaatcagcaacctgccttctgataacaatattgaagggcttgatcggatccgggtaaagactcttgaaataggccagctggtcttccgaaatctttaatgtttctgcaggaactactccaattcttaccatttcgaagaaagctctggccgttgcatttacgtcggcagcagcattatgggcctcatcaaacttacttccgtaaagtttttcataaagctcttcaagtttcgggggtttaaatcttcctccacgtcctccgccaagctgacagaagtcggtacccaaaatcatggtatctgctttgggcttttcctggagattgtcttttagattttttctgtaaaattctgctcctacaatattatagtcgaattctacattatgtccggaaactactcttactttttccaaaactttggagaattcttctagaatctcctgaagatctcgtccttcctcattggcaattttcgtagtaatcccgtgaattctggctgcattgaagggaatatcatacccttcaggttttattatataatcctggttttcaatcaagtttccgttatcatcgtgcaactgccaggcaatttgtaccattcttggccagttatcagagtctgaaagcggagcgttgaaattttttggtaaaccggttgtttctgtgtcaaaaattaaatacatataatgctctaacttttttataaaagagaatgtaaagttacttcattttttcgaattattggttggtactaaaacacaacaagtcaacaacattaaaacaacaaaacaactccgctttattaaaaaataattaattacaataatcataaaataaatatcaaaaaataagattaaaaaattagaattatccaccaaaaagcactatataataaatatttatcatatatttgatgaaataaaattttaatatttctatatctaaaaatgaagaaacatctacttctcatcagcactttggcaataagtttagtaagtgcacaaaacaacgacgcgttaaaaagagagtttgacagacaaaacaaagagaacaatgaaaaatttgactcttatgtttcgaaaaggttcggtagcgacagaagccctgaaacacaaaaaataattcaggatatgagagaaaatttggcaggatttagtggaaatgttccaaacttttaccaatcagaagatcaaaatcaaattttaaataacaatgtagatgcattaactactgccggaggtgtaaacgggctaaccggggcttttaaaggagaaggaattctgtatactatttttgatggaggaaggatttttgaaactcatacagcttttaataatacaccaggcagaattaccaataaagaggcggcaaccaatgcttatagtgcccattctacaggggtagcaagtattatcggggctaaaccatctcctctaacagctactagcaatggagtatcaatctcaggagatgcaatgggaattgccctgaattctacaatggattcttacagatttgcaactacaacattgccgggcaacacaaccacaagcactgtattcagtaaaattttactggctcagcctaaaatttcaaatcattcttatggtgtaaatgcggcctgggattacaaaactactgctaatgggtatccggccaatgcctggtattggggaggaaattatattgccggaactaattacgatttaatggggacctattatacaagtgatcagtcttatgatgccatcgtgtataataatcctacgtataccattgtaaaatcagccggaaactacttcgggttcggaccaggatattcaggcagtaccactacagcatattattataatggttccggatattcaacttatgccgcaggtacagccccacctgctaactgttcacaaggctacgactgcataggttacggatcattagctaaaaacattattgtagtgggagcaaccgatcctattacaactaacaataaaagatatactgccgctactgatgtagtaaaatccgattatagcagtgcaggacctagagatgatggaggtatcaagcccgatatttctgctccgggtaccgatgtctggatggcttctacagcagaaaacactacaggaagtataatgtggcagattaatagcggaacctcaatggcagcccctcaggtggccgggattatcggactttggatgcagatatataaatccttattcaacaatgcggaactcattgcttctgcttcaaaaacgctgatggtacattcagctcttgaagcaggaactgtagggccggatccatggtatggctggggatatatcaatgccaaaaaaggagctgaacttctggtaggaaaatccaacaacacgataatttttaataatgaaacattaaataacggcgctgttaatactaaaaccgtaaaagcatccgggtctgaaccattaaaagtaaccatatcctggattgatccggagtatacaaatattacgaaccaatgggataatttatataataacagagtttcaaggttaatcaatgatttggatgttaaaattattaatacagcaaacaatacagtatatcttccatggaaactggatgcaaacaatcctatggcgccggcaacaaaaggtgacaatacagtagacaacgtagaacaggttgtgatcgataatccaacaccaggagctgtttacaaaattgagatttctcacaaaggtaccttaaaaaataatgcttccccaagtgttactgcccctcaaaactactccatcattgtaacagggtttaccgaagtacttggaactaaagaagccggctttactacagatgggattgcagtagccccaactgttgcaaaagatttcactaatatattaaaagcacctaaaaagtctgctttcaacgtctatgatcttacaggtaaaaaattacaaagtggtactatcaataacgatacagaaccaatagatttatctgcctacacaaaaggaatttacatcattgaaataaaaacaggcaaagatgttatttctaaaaaagtgatcaaggaataacctatatacacaaagatttttcacaaaatactaacagttgttagtattttgtttttttatgtatatttgcttcctatggaaaatgcacttcacgaaaaagtttctcaggatatattactcaaagcgtataatcatatgatgcttgccaaggcaatggctgatatttacgaagaaaacagaaacgtatgcaaatacgttcacagtacttcgagaggtcacgaagctattcagcttgcaacagcttatcagttaaaaaaagaggattgggtttctccttattacagagatgaaagtattcttctgggcattggctttgagccttaccaattaatgcttcaactactggctaaggctgatgaccctttttcgggaggaagatcctactattcacatccctcaagcagagatgagaacaaaccaaagatcattcatcagagttctgcaaccggaatgcagactatacctacaacgggagtagcacagggaataaaatatattcaggacttcaaccttcagaattttgaaaataatcctgttgttgtctgcagtcttggagataattctgttaccgaaggtgaagtaagtgaggcattacagtttgctgctttgcaccagcttcctatcatctttcttgttcaggataatgaatggggaatttctgtaacaaaggaagaagccagaacatgtgatgcttatgattttgtagcaggatttacaggactaagcagaatgagagtggacggtactgatttcgtggaaagtttcgaggctatgaaaaaagctgtagactttgtaagaacagaaagaaaacctttggtggtttgtgcaaaaacagtactgattggacaccacacttccggagtaagaagagaattttatagggatgaagaagatttaaccaaacacagagccaaagatccgggagaaatccttagaaaatatttactggaatcaggtgctgatgaagatcttttaaagcaaatcactaaaaaggcacgtcttgaagcagaagaagctttcgaaaaagccaaaaatgcagaagatccgaagcctgaaaccgttatgcagcatgtttttgcccctactcctatcacggaagaaacagggacacgtgagcctgcgaacggtgaaaaaattgtaatggttgacgccgctatccacgccattcaggaattaatgtggaaacatcctgaagcccttctttacggtcaggacgtaggagaaagaataggtggagttttccgtgaaacggttacattaggaaaaaaattcggaagcaaaagagtattcaacacagcaattcaggaagcctatattatcggatccacaactggtatgagtgctgttggattaaaaccaatcgttgaagttcagtttgctgactatatttatccgggcataaaccagttaattacagaaatttcaaaatcaaattatttaagcggcgggaaatttccggtaagcaatattatccgtgttcctatcggagcatatggcggtggtggaccttatcacagtggaagtgttgaaagtattcttgccaatatcaaaggaatcaaaatagcatacccaagcaatgcagcggactttaaaggtttgttaaaagcggcctattacgatccgaatcctgtagtgatgcttgagcacaaaggattatactggagtaaagttccgggaaccgaagatgcaaaaactatagaacctgccgaagactatatacttccgttcggaaaaggtaaagtaatcattgaggctgataaaactgaaactgaaaagggcagaaccgtattggtagttacttatggtatgggagtgtactgggctaaagaagccgttaagaatttcaacggaagagttgaagtaattgatttaagaactttaattcctcttgatgaagaacttgttttcgaaagagtgaaagcacacggaaaatgcatcgttctgactgaagaacaacttaataactcatttgcagaagcatttgcacaccgtatttctaaaaactgcttcaaatatcttgatgctcctgtagaaacaatgggatcattggatgttcctgcagtacccatcaatcttgtactggaaaaagaaatgcttccgaatgcagagaagctttccaagaagatcgaagaaatgctgaaatattaaaaataaaaaactctaaaaatattttagagtttttttattttatttcttaattattttctttattatcattcccttttctgttttaacttttaagagataaaccccatttattaaactgtttaaatctaacgaaatttgaggtgtattagcttgctttttattcaaaactaaaattccgcttacatcatatatttcaatgtctttaatttcattatctttcgtggacattagattaacttcagaaacaacaggattaggataaataataagcgatagagccttttgatcttttatattactaattgtttcattaattcctaatgtaattggattaacatccattacatataattcattaccataaaaattaaaattattcgaatcattaaatggagcattcaaaaatattttattatttacttttgaaatagaattaattattttgctgtttactgttatattattagattgaatagatattgggcttactggtccgctaccattagtaacccatatttcattttctgaatacgttttattaagaaaaaacaaattaccattgatacaaacattattataaggtatataattatttggtaaaaatgtagaattacctagagatggactagtgtatacattactaaactgcccattattatatacccacatactattgtatccattgtaatttggagcactcatataataaattttattatcacaatgtgttataaaacttccactatgtgaagctacaggataagctccattagcaaattcgttacttgaaattttataagtaccattaattgttccatcagaaacatatggggcatgttttgttaaatccgtagtattttcagcacaagcaaaaaaatacaatttcccttctttaacatctacattactattgaaacctggattggaataatgaggattactgaaggatttcaacatcaacgttccatttgcagatccatcagaaacccaaagctccgttttgcttgtccaataatctatttgattattcactagaaagaaaaacttattatcagtatatcctaaaattgaagaaaaacttttgtttccaacaaaattataaaatacctgagtaccattctgagtaccatctgtagacatcaacactcttttgtttaaggtataatcaaaagcagcataatatgatttattatttataatagcatatttattttggaaacttggaagggcatttaaattataagtcccgttttcagtaccatcagaaacccaaagtttagcagagaaattattttcacttactttaaataaaaacttgtttgtattccctactctggcaaaggatggataatcataagaatttgaaccatcttttcccattgggttaacattcttaatcattgttgtacccacacttgtcccatcactgccacataatgctataggcgcccctcctattgaacatggaaaatagattttattattcagctgtatactgggaacatagtcgctaaccggccaaccatagaaacctgcattaacatcattttttattctatatgttccagtagctgtcccatctgaaatcattgggcctaaaccatattcatctgttccaaaataaaaaagtttattattgaactcctgtggagataataaagaagatccagtagtagaatttgcattttcatataaatctgaaagtccattgctaaaattaaacttaaaaatttcctgcccatactttttattacctgcattaataataaaattattgtctggtgtatctgtaatctccattttaaaaccagaatcataatcgaataataaattctgaataggctttaatgaagttccattaaatgctatgaaattattattgttattattggaatatgtgttaaaaatcaaataattactttcgccgaaattcgaatttgatttttctacaatagatgcagtctcaagttcaggaaatacatccgtaagcttaatcaatgtactaccatcataaaataattttgtatataagttatttcctaataaacagttaaagtaaatattatttttaaaaaagtaaatattattgacattttgaagatttggatataaattagaagtaaccatatgggttcctatgcttgtcccatctgatttccacaaagaattattgttaaaaaagaccaaagaattattctgtaaaaataaatcttcatttccgctaatcattccaggaagatttaaaacatctacaatggagttgttgttaggatcataataagataaggacaggacattattcttcctttttataaaataaacgaaaccattaaaaccaaccatttttccttcaacagtaaaatcgtcttgtataccgctaaaaacaatagaagtatttgatattgttccatctgacttccataatttcctttgagaagaagaattataattggtaaagtacagaatattgtttacgtttacgtaattattagttccactgttaaaattattacttatcgtattggcaatttcagttcctaaagaagtttcatcagaaacccataactcattccttgttggtgatccgaactgatgaaagatatcaaaaataagcttaccattaatctttgtaaatgctgtaatactaaaatctgacgttgaaaaatttacattaggaaattctttaatcatttttgtaccagcatccgttccatctgttttccagagacttaattttgagttcttttttataaaaaaataggcattatgatcaattacagaaatatgtaaagctttcgtcgcatcatacgtatatgtataatcttcattgacatagtttttatatgctgaacttattttgattaacaatctgctattttcattacccgagccttttattgtaatcccaaatttagtattgaaaatcaatttatcagaagtaataaaattcatttgagagggcttactatcagcactaaaattagtttccaatagattagctgttgcttgtaaattctgtcctagaagatcaccattttttagtaggcttaataacagaacaaaagaagcaattttagatattttcatagttaaaaatttttgcaaagataattatttcaaccttttttatattgttatataagtgtaatacctccaaataccgagacgctttctcataagatcgaagaaatgctgaaacattaaatatatgaaacctctgatttttcagaggtttttttattaattttaataaacagaacggatacctcattttggtattcattttgtttatatgcacacctaatttcatacgttttatgatcacaaccaaatacgtcaattataagcaggtcctcaatttatcaggttttcacctcatcctgatttctatctggtgtactctgatcgctgtactgttctatttcttcaactggcaatggatgacaattccatgggttccagttgccctgattggtaccgcagaagcattccttgtaggtttcaaaaacaaccaggcgtacgacagactttgggaagccagaaaaatctggggaggaattgtaaattcaagccgctcatttgcttctatggtttacgcttttgatactaaaaatgaagaaatcggtgtatttgatcttgaagatcgtaaaagaaaaattgtttaccgtcatattgcctggttgtatacttttcgtgagcagcttctggttccaacggaatgggagcatatcagcacagaaaataaattcggcaatattaatctgagaagaaacagattgatcaaagcaggatttccggattacggaagagctcccattttcttacataaatacctttcagaagaagaatatgatcttaaaaatgattataaaaacttcgctacctacctgattgcccaacaggcaaaagatatcaacgagctgaaaaatatgagtgctatcacagattttaaccagactcagctgcagaacagtctgaatgaattctataatttccaggggcaggcagaaagaatcaagaaatttccttcaccaagacaatttgccagtacagcctttgtttttaatatcctgtttattatgcttcttccgctgggattggtaaacgaattcgcaaagcttggcgactggggaatctggacctcaattcctttctgtatcatcatcggatggatctacatcataatggaattagtaggagattattctgaaaatccttttgcaggattaatgtttgacgttcctatgctttctatctgcagaaccattgaaattgatcttcttcaactaggcggagaaacagaacttccagaccctatttcttccaaaaacggagttttggtataatttctttttccgaaaatcattgtaaaaaacttcagaatatatttcagatttcattgttatttcataacttagagagttgaaaacatcagctgaaatctgtccaaaattgagctactgttctatttcggacagattttaacttataattttctccactaataattgatcctttctttttaacaatgagatccaagcaagtactgcaggttatgacaatgctgtgtcttatcctattctgtcctgaaataaagtcacaggctgccttcaataaagaattacccaaagagtttaatgaaaaattcaccaaagaaatcaacgacagtattccttctctggggtcattcattgtttctcagaatgacaggataatttatgagcaatactctcacggagccggtaaagagactgttttcagtataaaatctgtcaccaaaagtattgtttctgttcttgcgggaattgctaaggataaaaacttacttcccaatctcaatacgccggttttaaagattcttccggaatacaatgtatcaaggagcagttttaaaaacatttccaatatcgaagggaaagtgattcacgattcaataagaaatacattaacattaaaaaatctgctgaccatgcagggaggttttgactgggttgaaaattccaaaatctcgacagcaatgtcattttccggtgatcctgtaaagtttgtgctggatcttccttttgaggaatatccgggaactgtattcaattacaacagcggtgaatctcacctttttggagctgcactcgcaaaaattgtaaagaccaacctcaagcaattcgcaacagaaaatcttttcagagcattaaaaatgaatattccccgatgggatacagattccatgaacagaaaccttgcaggctccgaactttttatgaagcctgaagatatgttgaaatttggtttaatggtcctgaacaacggaaaattgggaggcaggcagattgtatcccagaagtggatccaggaatctacagccgaacaggtaaaactgaattcctgggacgtaatgccggatgccaacggatatggctattactggtggcgaagaaaaaccaacggacatcaggcttttgtagcaacgggttatggcggacagcttatctgtgttatcccggatttaaaaatggttatcgtaacaacgtgttttttaaatgacgaaaacagaggcagaaccgagattaaaaggctccattattttatcgataaaatgaccaaagaagttttataacaacaaatcttacattcagttgagatacggtaatctataatacgattgctgttgtattttttacttcagaaatcataaatgaactgtgtgtacttgcaatgtgctgaagtgttgtaagtttcgtcagcataaaactgcggtaatcttcaatgtccttcactcctattttaaggatgtaatcataatctccgcttacatgaaaacattctgtaacttcctcaagatccattacttctttttcaaactgaagtacaaattcttttttgtgctggcttaattttacgtggcacagcacaataaaatttttcttaactttactcttgtccagcaaggctacatattttgaaataacgcccgcattttcaagctttttgacacgctcataaattgctgtaacagacaatccaagcttaccggacagttctttggtggtttgtttgcagtcttcctgtaaaaaatacaggagtttcttgtcagtttcgtcaagttccatagatatttttttggtaaaaatttaacaatcccgaagatactaaataatttttctaaacaaataatattttacagttttattttctataaattcaaatctatgttgtaataattaacaaattaatgcaaattgagaccataaaataaaaacgatatttatggaaaactttaacgccgccaatgagatccaggatcttcagtattttggtgaattcggaggagtgaatccttctatctctgacagctctacttacacattcctttctgcaaagaccatgtttgatacctttgaaggaaacgctgaaggatgttatctgtattccagacattcatccccgatgaacctttacctggctcaggctcttgccaagatggaaaatacggaatcggccaacgttacagcatcaggaatgggagccatcacttctgttttgatgcagctttgcaaaagcggagaccatattatttcaagcagaaccatctacggaggaacctatgcttttcttaaaaatttctttccgcagtttaatgtagcgactacttttgttgatatcagcaactttgaatctatagaaaatgccatcacacccaatactaaagttatttactgtgaaagtgtgagcaatccgcttcttgaagtggcagaccttagaaaactttctgaaatctgtaaaaaacacaatctgaaactgattgtagacaacaccttctcccctctttcgatttctcctacgctattcggggcagatgttgtgatccacagcctgacaaaattcattaacggaagcagtgatacagtaggaggtgtatattgtgcaacacaagctttcattgatgatactaaaaatgtgaattcaggagcatgtatgcttcttgggcctacaatggatagtttgagatcttcaagcattctgaaaaacctgagaacattacatatccggatcaaacaacatagccataatgccatgtatcttgcggaaagattcgaaaaagacggattaaaggtttcttacccgggattgccatcccataaaaaccatgaattgatgaaaagcatgattcatgaagaatacggatacggaggattactgacgttggatgccggaactacagaaaaagcaaacgaactgatggaactgatgcagacagaaaacctgggttatcttgcagtaagcttagggttctacaagaccttattctcatgctcaggaaaatctacctcctctgaaatccctgaagaagaaagagcttccataggcatttctgacgggctgatcagattctccatcggtcttgaccacgatatcaaaagaacttaccagaaaatgaaggaatgtatgttgaaagtaggagttcttaaccaccatgaaaacatttccatatcctaaatttattgtaaaaggctgtttcgtttttgaaacagccttttttatttatcaatccacctttagatttggaataacaaatgttaaatataatctattatagcttttggctaaagccgttgtaagaatttatttattataaatgggctgaagcccattcctattgaattttattggcaactattaccgatgttatttcttataataatgatgcggaaaggcatcctcaggtttcattctgaaaacattgagcagtatccaggactttaagaaaccgtatccgtaagaaaacatctgaatataagtggaaataaccgccattccggcaatactgatatttttagtcagtaataaggcatgaaacaacacaaggaaagtatacaaaccataaaaagcaaggatgatccctctatgcatgatgaaatactccagaaatcccattacatatcccaacataaataatgtaggaaatgcaaaagatattttcacataattcgggtgtctttgattaagaataggccttgcacagccaaactgatagacctgtttggagaattttccaaaatcgactctgcgtttatgataaacagcaatatcatcaaaaaaagcagtggtaaatccattttcccaaagcgtcatcgaaaggtccggatcctcaccaattctcatttcagaaaatccgtctacttttttaaagacttcctttttcacgcccatattaaaacttcggggctgaaatttggaaaccgatttcttacttcccctgattccacctgttgtaaacaccgatgtcatagaataggaaatggctttctgcatcagattaaatcctttatgcgctttatctgcccctccaaaagcatcacagggaatggtcaggatatcgtttttaatgtgctctatataatctttttcaacgatgacatcactgtctacaaacaccagccattcatttgctgctctggctgccccatagtttcgtgttaatcccggtcctgaattatcctttctgaaatatttaatatccagaattccatcaaaatttttaatggtaggtttcagatcgatgagagaaccatcatctacaataatgatctcaaactccttatccgtctgctgggtaagggaggtcagcaactcaaaaagctcgtcttttcggttataaatagcaacaacaatggaaatagtgggtttcaaattgaaaatttttcaaaattacttattcgccggacaaactacaaacagtttaacagcttattcagagaaattaacgatactgagttttattcaccttattacatggaagttacaaatgaaattctggaccaagttatttggaattttgaacaaaacgaatcccggcaatccatcctaattttgctatagaaatttaaaccaataaaaaaatggaatctattatcagcacattgcagcagcctattcaatcaggttttaatgctttttcaacagctcaggaagttattcaaggaattgatcttaccggaaagacagtgatcattaccggtggctacgcaggaatcggccttgaaacaacaaaagtacttacttcagccggagcccatgttattattcctgcaagggatattgaaaaggcaggaaaaaaccttacaggaattgaaaatattgaactggaaaaaatggatctgatggatcccgcatccatcgatgcttttacagaacgatttacagcatcaggccgaagtctggatattcttattaataatgcaggaatcatgtgggtaccccttcgcagggacagcagaggtatagagtctcagttggcaacgaattatcttggacagttccatcttaccgcaaagctatggcccgcactgaaaaaatcaaataatgcaagagttatctgtgtttcttcttatggacatcagatggcaccgtttgattttgaagatcccaattttgagaaaagagagtatgacactctttccggatacggacaatccaaaacggcctgtaatttatttgctgtagcattggatgaaagaggtaaagaacaccacatcagagcctattctcttcatccgggttctgtatatggtactgatctgggaagagaagaacccatcgaactttttaaacagcttgggacacacgatgaaaacggtaatatcaaaccggaagtgcaagacagattaaaaactattcctcagggtgctgccactacagtctggtgcgctgtaagtccgttacttcaagaaatcggaggtgtttactgtgaaaactgtgatatagcagaaatagacagaggacaaatagaacacagatttgatgaaccggcaactattcgtggagtacagccctattctattgataaggaaaatgcagaacggttatggaaattaagtgaagagatgcttggattccggtttgataccaagtaattgtttttaaatacatttgtaataaaaaacttttgataatggatttccagatacaatatctcacaccggatatcaagctttccagttatgatgacaagctcttcaaaacagaaacagtttttgaataccatatgttggtctggttcatatcaggagaaacaaaaattattcaggcagataaaacctatgttttcaaagcaggagatattttcctgattccaagaaatcatcttgcgaccattatcaactatccgaaagacgggcttccacataaagctgtagtgatgcatcttacgacagagcgtctcagagatttttacagttctgttgatgatcaaaagaaaaacagccagcgggaatccagtatccacagtttcagcagccatcctcttctgaagagctgtcttacctcactcattccttattttgaaattgaagggccatttcccgaaaatattgcttatttaaaaatcactgaagcaattagtattttaagagaaattgatccggatatagatgctgtacttgctgattttaatgaacctggaaaaatggaccttattaattttatggaaaagaattatatgttcaatatgcccctggaacgatttgggtatctcacaggaagaagcttatctacgttcaaccgggatttcagaaaaatatttcagacaacgccacaacggtggcttacccaaaagcgtcttgagctggcctattatcatttgtcagaaaaaaacaaaaaaccttctgatgtatttctggaggtaggttttgaagatctttcccacttttcacatgcttttaaaaaacagtatgggtttgctccttcattggtccgataaaaacaaaaaggttgtacctatcagtacaacctttatcatttaaaatatcttctgataaaataataattattctggttctttttggatatattgatattttgaaggtttgacaccaacagtttcttcaaacactttgacaaaggtagaatgatacctgaaacccgcctcagtatatatttctttcattctttttttattatcctgtaactccctttttacatgttcaatcctataccagttaataaaattattaaatgtttttccttttttatttaaagcagcagacgcataagatctatttgttcctacaatctttgctaagtcttccaatctgaaatcgggattggtatatgatttttccatctctatatgtttgaccatgctctcatagattctgtttaactttatatcataaacactttcctgagaatcagattccaactcatcataaaaaaccacctcttcaggttcattaatttcatttttttcatttattctatgttctatatactcctcattatgtaaatagaattgatatataataatgatgattaccattataaaaaaaatgatatctatatagtttaaaataaataattgatcttttgataatattttaaaagctaaactcatagtatccgagagtccaaaaatattggaaataaaaggagccaggattatagaggcaactgtgaagattgaaacattaatggtctttttaatattatgcagaaacaaactgcctaaaggaaaagctgcaccccatattatattaatgggcattacttcccaaaatatcatgttgctaataaaatatatagctatgtaaggatataaagctatctgaataagatgtacaaaatcaaaattttctttataattccagactacgataaaaatgtaaagagagaacactgaaataatgaaatggtgaattacaggcatgataagcccccatgtatggtacagaatacaaaagctcaaagaaataataagcatcacgaagataaaacttaaagtgattttctttttcgatttattgtagttcattgatgatatttattttctaaatcgcaaaaatagagattattttattttagtgtttattttagataaaaacaataaaaaacataatcgtcaattttatttattggtaaaaaaaataacattatcgtcaataaataaaaatacaaaatattgaatatcaaaaaattaagttaaacccaaataaatatactcaatcttcatcgtatattacttctttacattttcttatatcatatttgctgtatagtatcacacaactgttgttcttaattcttaagcaaaaataatattaaggacctctatactattgaatgaaaccagatctttcaaaaaactttaaaatttcataacgcaaagaaaaaaaatggatttcaaagaaatacatataggaaaattattacagaaaaaagtcagggaggagaagattgaggtctcaagaatatgcaacttcttcaacctttcagaaaaagacattgataacatgtatgaaagtgtatcattagatatcaatatcatccttaaatggtgtaaattattacaatatgattttttcaggctgtattctcagcatctgatcttatatgcccctaaggggaacaaaaaactgaacaatttgaaaagttcactgccgagcttcagaaagaatatttatacaactgaaattatagatttcattctgacagaaattaaaaagggagaaaaaaccaaacaggaaatagtaactgaatataaaatcccaaaagcaactctacacaaatggatacaaaaatatcaaaagtaaataaaacgattcctgactataaaagaatttatacggatatgatccaaaaaagatatccgcataaaaaagaagaatgcagaactattttagaaaaaaataagttaactacattagatatactcaagctgaacgatataatttcagatgctcataattctgtggcttgcaaatcaaatcaaaaacacaagtcttatgactcagaaacaattataaaaatattagagtaccagaaaaaaaataagatcgccaattaccaaacagctatttactttaatatgagcaggaatactattacaaaatggaaaaaaaaatatgctgtctagaatcagccattaatcaagacctccacaacaaaagcattttatgtaaaatcccaaataaaaacatattcaaaataattacccatttatcattttagaactccatatcactaacattcatagtatgctccagaaaatcaataaagtattttggtaaattctcatagaagaacagcattcttacggatataggcaagatctgcacagttaacaaaaacacatagaattattcatttaaattaaatacaaacatgaaaaaaaaattatttttattgggatttggaattatctcaagctatttgttaagccaaaatggaggtgttggaataggaaccacttctccggatgcatctgcaatacttgatataaattcaacaaataaaggggttttggcaccccgaatcgccttgacctctactacagatacgactaccataccttctcccgcaaccggattgttggtatataatacaggaactgccggactttcttttgcaggatatgtattttggaacggttctgaatggagaagccttaacaattcttctcttacaattggcacaataggaaatcttctttgtagtaatgctaccctttctccggagacttatacccaaaatgttccctattcaggaacattgactattccttatactggaggaaacggtggtacttatccctcgcaaatcatctcttcaaatgggcttacagctacactgcagtcaggaaacctggctacgggaacaggaaatcttatttataatgtatcaggtactccaacagtttcaagccctacagtaactaattttaccattaatgccggaggtaaaacatgtactgcttctgtcggaataaaaaatacaataggagtaggttcagaaatttattggtatggtaccgctcctgcaaatgtaggaagcggcggattgaatgctaccacaacagttcctcaaaactatatgagttattatgctccggatatgcccgttatagaaggtgtgagacttgatatttattttattgatgatgttacagcgagtggcaccgtttccgaaatgatccgtttagtaaatgtttccggagccaatgtaaaagttaacttttcgttactgtcaagtttcaatagttttggtgcctctaatgtatggttaggaaatggacagtttattaatctcgataatggaaattataatggagatgggttaaatatgacgaccagcagcacgcctcaaagtcttcctgatacaaccatattagaatttcaaaatgaaattacaacagttcacttaacgatcaatggacattggtacagagctgagtttttcactgtgattgataataataatacgaccgctactaatgatgatattagaagagcaggaatagtaataaaaagattaaaataaacaacacataaactaaaattaagcagaataacagcttagagatctgatttttctttaacgaaaaagcacagtcgttcactaatgaatgaccgtgctttttataatttattataaaagctaaaatccagagaatcccaatagtattgtaattactttttctgtaaaatattctgattttttgtttctttctttttagatattatattgtgattcagagcctctcttttaggttttgaatgtgatgattttgattcagaactaaaaagaccgaatatattcaaaactaaatcaaatatttcaaaaaaattccaggacattattttattttagttatttccttccagcttatggaccttcttcgttccttcgtacatttcgtactgtaaaaatcttgtttccagctttccgttgaaaagtttgatttttctggaaggacgtaatccgattttcttcactgcctccaagtcagaagagatgagccatgccaatgtattcggataatttgttttaaaggtatctccgatttttttatagaaatcatcatcattaatggaaattctctcatcgtacggtggattgaataccattaataacgggaaaagctcttttttggaatcaaagaagttttgttttttaatctcaataacatcttccatttccgctgcttctacgttcattcttgcagcattcagcattcttgcatcaatgtcgtatcctacaatttttccatcaaattgttttactctgttaattctgaattctttgatctttgtaaacagatcggcatcataattattccagttctgaaacccgaatctctttctgaagatctgagccggaagatccatcgcaatcatcgcagcttcaatcagcaatgttcccgaaccacacatcggatcaagaaaatttccttttccgtcccagccagccagctgaagcattccgcttgccagcacttcattgataggtgcttctccctgctctcttctgtatcctcttttaaacaaaggatctcctgaagaatccatggaaatcatcaccagctccctgtcaatatgaagatggaatttaatatctggatttctcgtttccacattcgggcgtcttttgaatttttcctgaaaataatccacaatggcatccttcatttttaaggtcacaaactgtgaatgcttaaaggtctcagaatttacggttgcatcaatagagaaagactggtcaacatccataaaattctcccattcaaatttgaataatctgtcatagaactgatgctgattaaaagctttaaattcatgaatcggcaccaatattttcaatgccgttcttgcagaataattgattttataaagaaagccaagatccccttcacaatttaccgctctgttcttgatttcaacatttcttccccctaattttttgatttcttctgccagaatctgttccaatccgaagaatgtttttatctgtatttttatattttctgtatccatacgtataaattaaaagatttaaagctttaaaaattaaaagattagctattcaatttcttgtccaattgaatttttcaatctcttaatgttgtaaaatactttgcttttaaccgcacaaatttaactatttttgcgttatggaatggtttgaatcttggtttgataccccttattatcatttgctttatagcaacagagactatactgaagctgaaaacttcattacaaagctcactgcggatcttcagcttccgcctcagtcgaaaatcatagatcttgcctgcggtaaaggaagacattcggttttcctcaacaaattagggtatgatgttttgggattggacctttcaagacaaagtattgaatctgataaacagtatgaaaatcaaaccctgctttttgaagttcatgatatgagaaacccgattgatgcagatcctatggatgcagtattcaatctgtttacgagttttgggtattttgacaatgaaaacgacgacaaaaaggtatttcagtcggtttacaatgttttaaaacccggaggatattttgtactggattatctgaatgaagaatttgtaagaaatacgttggttcctgaaaccacgattacccgtggggatattgaattcagaattcttaagaagattgaagggagacacgtcatcaaagatatccgttttgaagcggatggtaaaccctttcatttctttgaaaaagtaaagctgcataccctggaagccattcacgcatatgcttcagaatgtggctttgaaagaataaaaatctggggagattatcagctgaatgaatttaaaaaagaaaattccccgcgatgcatcaatttatttaagaaaaaataatgacaacagtatttttactgattttaagtgtcgtaacaggagtttttctgggaaaacactttggtaagaaagagaaactggccaaaaatcttctgatattaagtgccggttttctgatcacgatttgtctcaacgaagtcttcccacaggtttatacctcatccggaagcagtaaccttgggatatttgtcatcgcaggagtacttcttcagatgattctggaggctcttaccaaaggttttgagcacggacacttccatcatcatagtgagcataatatcctccctgttgctttaatggtgggattattcattcacgcctttattgaaggaattccgcttgccaatgaagagcatgagatgtcaccctacctttggggaattgtatttcacaatcttcccatatcatttattctgggagcatttttatttaacagaaaaggagaatcaaaagcctcctcatcttatccttccattctcattgtagccttatttgccctggcttctccaatgggaatgttattaggtaattatttcaatccggatcttcagccctattttctggctattgtaggaggaatttttcttcatatctcatccgtgatcatttttgaaagcaataaaaatcacaatatagactgggtaaaaatagggttggttgttttaggtgtttcacttgcattgatgatgcatctttttcatcagcatcccactgctcattctcattaaaaataaaaaaactccggaatatccggagctttattatatagagcttatgtaaagcttagaatttccatcctaatgtcaggaagaaattatttctgttgtttttcacatcgcttactgcgtacgaatcactttcgaagattttacttgaagaataataagatgaatcaaaattatcgcccatatatcctctcataaaaggattggtatatttggatgagatgttctgataagatgcatcaatatagaatgacttgaaatcatatccgataccgaatgaaagcgtgtttctgtcacttagcatcagattgctgtaagactggtcacccacagtaccggcatcattaaatctgctgatggtaagcgcatcaaacggacttgactggtaagaataaccacctctcaacctgaactgctgtaccctgtactcagcccctactcttacttctgaaaggttcttataattatctttgaagaagtcgttcaattctctttctgcacctccgtatactttgtaatcaggttttgtaagtcctagcgtatagtctacgtttaatgagaaatttttacttgctacaaaagctgcactcacagtcgctttaagcggtgaagtaaactttctgttttcagcacccatatcatctccgtaaaccggatcgttgtagaaataataatttctgtctattgtccagaatgtcggcgtttcaagggatgcacccactctgaaattaggacttaactttccgattacccctaaagaagcagaaaaacctgacgatctttctgaatagggagtatcctgcttactgaagccttctgttgaattattagtcagatttcggtaaaataagctgtcatactgatccagtgaggcattgaagaaattgaacccagctcctaaatataaattatgattataattggccccaaccccaaagctcatctttgacaagttcccatatctttcatatatatgacccgccaatgcagcatctttggtgatatcatctttatcaaaagcatacacaatattattatttcccggtgactggattacattgtccagcgtctggttagagaaattaataccaatattgataaatttccatccggtttctgtcatcaaaggaaaagcaatgattcctccggcatttccaagatcacctttcgtcttgctataatctatggtagctcccgctaaagaactgctatttttatttcctaaaatagataaagttcctgaaacctctcctgaaatagctacccctaaacctgcagggtttgtaagcaaagaatttgcatcaccacccagcgcaccattagctccagccattgcattaaacttagctgatcccaccataggagtacttgagtaaacttctacagtatttcttatcacagaaacatcctgagcctgcgcataaaatgcagcagaaatactcattaatactaaagatttttttaacattattttttatatagtttattagtttgaacaattatctgaagcctcctctgcctccgccgccggatctcattccgcctccgcctgaagaaccacctctgaagcctccgcctccgccattgaaaccgccgctggatctgaaacctccggaatcattagacctgaaacctccgttattgtatcttggctgcgactgctgataattataattaggtcttgtttgtggtgcagaattacggaatccaccgttagattgagtatttctgaatcctcctgaacttccgtttctgaagcctccggaattacctctgaagccaccatttgaattagagtctctgaatccgccattattggtatttctgaatcctccatttccattagtatttctaaatcctgagttagctgtattggttctgtaaactgcattagctacccctgtattctggaatcctcctccactgataccacttcttctgtaaacaggtctgttgtaatagccaccaccccagtagcctcctccgtacccccaatatgggtttccgtagtatccgccccagaatggatcataatatcctccccaataaggagagtatccccagtatggacttccccatccgaaagagcctccccagccccagccgaatgatccgccccatccccaggaaaggcttgcaccccagccccagccgcggttccagccccagccccaatatgggctatagccaccataccatccccaaggagatccccatccccatgagttgtcatagtagtttgtctgagaacccgcataaagtccccagtcggaatctgtagcagtggtattccaatttggattggtaccgctccagtcattatatctgttctcctgctcacggctattcgcctgggcattctgaattacgttggaatcctgatagtagtcataatattctcccactctgttcccgctatcattaatgataactccttcaggtagcgtatccttattggggtcgtaatacaccccgtctgtctcgctataccctcccatctgagcaccacaagacacaagtaataatccgcctgatatcgccagaatccctttggatcttagcagaccaagcaaatttttatgtatatttcttttcatgataacgtaaaaatttttaatttaaattatatttgcaatctgtaccaaaaatgtaccaaaataccggtaaaaaaatctatcaaaaatagatttttatttttagataacaataatgtacaaaagttaaaaaaattaaaaaaaataatggcaaaattaacctcaagaagcgaagattacagcaaatggtataatgagctggttgtaaaagctgatttagctgaaaactcaggcgtgcgtggatgtatggtgatcaaaccgtatggctatgcgatctgggaaaaaatgcgtgatgaaatggataagaaattcaaggaaacaggtcacgttaacgcatacttcccgctttttgtgcccaagagcttgtttgaggcagaggaaaagaatgcagaaggttttgcaaaagaatgcgctgttgttacccactacagattaaagaccgatccggacaacccatccaagctgattgtggacccggatgcgaaactggaagaagaacttatcgttcgtcctacttcagaagctattatctggaatacatacaagaactggattcagtcttacagagacttaccaatactgatcaaccaatgggctaatgttgtacgttgggaaatgagaacacgtcttttcctgagaactgctgaattcttatggcaggaaggacacactgctcatgcgacaaaggaggaagctgttgaagaagcagaaaaaatgaataaagtttacgcagattttgcagaaaacttcatggccattcctgttattcagggattaaaaactccttctgaaagatttgcaggagctgatgaaacttactgtattgaagcattaatgcaggatggaaaagctttacaagccggaacttctcacttcctgggtcagaattttgcaaaagcatttgatgtaaaattcaccaacaaagaaggaaaaattgagcatgcatgggcaacatcttggggaacttcaacccgtctgatgggtgctttgatcatgacacactctgatgatttcggattggtactgcctcctactcttgcgccaattcaggtagtaatcgttcctatcttcaaaggggaagagcaattggagcaaatcagcgaagtggctttggatattcaggctaaactgagagcaaaaggaatttctgtgaaatttgacaatgatactcagaacaaaccaggctggaaattcgcagaatatgagttgaagggagttcctgtaagaattgccatgggaccaagagacctggagaacaaatcagtggaaattgcaagaagggataacctgactaaagaagtccgttctattgaaggtcttgattcttatattgaagatctattgaaaactattcagcaggatatttacaataaagcatttgagttcagaaaaaataatatcacaaaagtggatacttatgaagaattcaagaaagttctggaagagaaaggtggatttatctacgctcactgggatggtactgctgaagaagaggaacagatcaaagaagaaaccaaggcaacgatcagatgtattcctttggatgatgatatagaagaaggtatttcattgatctcaggaaaaccgtctaaaagacgtgtattattcgcaaaagcttattaataattttaatgattttaaaaaaaatcattaatttttaaagaaatattcaaaaaaaagtgacatttggacggatttttgtttaaatttatatcaacattaatccaaaaaaatttattattatgtctttaaatgtcattgatttaattaaaggacaattaggtcccgctttggtttcacaggctgcatcgcagtttggagaaagtgaatccggtatttctaaagcaattggcggattattacctgctgtagtgggtggattagccaataatgcagataagcctggcgttgtggatgctattacacaggcctcttcaagtggaattttggggaatctattaggcggagcgtctaataaccctattatttcgaacttgctatcttcaatatttggagataaaataagcggactggtaaattccattgccagtttttcaggagtgagtaacaccactgcaggttctttattaaacctggtgactggagctacagtaggtactgttggaaaatacgcagccgacaataatctgggggcttcgggtatttccagcttactgaatgatcagaaaggcattgtttcttctctgctgcctgcgggactttctttggcatcctttggattaggagctgaaaattggtttggccaggcaaaagaaaccgtttcttcggtaacttctacagctaaagataacatcgctgaaagtgttgctacagcaagagaaaatgtttcagaaggagctagagaagtaagagaaagatttgaaaataacaacaataataatcaaggcggaggttcaatctggaaatggttgcttccgcttttattattaatagctgctgcttatttcttatggaaacagtgtgagaaaaagcagaccacgacaaccactaccactacgtctgattcaacagcaaccagttcaactactgatacagctgctgctacaggaacagcaacgcccgcaccggcaaccgctaaaactgatgaaaacattgaccttaacggggtaatgctaaaaggttacaaaggcggaatggaagaccagatgatttcattcctgaaatccggaggttacaaaaatgcagctgatgattctgcgttgaaagataagtggtacgacttcgatcatgttaatttcaaaatgggaagttctaccgagcttgaagctggatcacaaggacaattggacaacctggtagctatccttaaggctttccctgatgcaaaaatcaaaatcggaggatacacagacaaaacaggaaatgaagcttccaacgttaaactttcccaggcaagagctgattatatcaaatctgctttagctaaggcaggtgttggaggtcaggtacttggtgctgaaggctacggaagtaaatttgctaaagtagatgcaaaagcttctgatgctgaaagagctgctgacagaaaaatgtctgtaagatttgccaagtaatctttagactcaataaaaattagatcccgggaactagttcccgggatttttttatcttatgatttttctgtttacatatatttaattaaatttgttagtcatttctaacatttatgaatttgaatttaagaagcgcctggcgaaaagataaaacagaccattccttatcagaggtctattcatcgatcaaagtacctaaaaatgcaactttctggagaaaataccttgcctttgcaggacctgggctaatgattgccgtaggttatatggatccgggaaactgggctacagatattgcaggaggggctcagtttgggtatacactactttcagtaatccttatctccaatatttttgcagtggttttacaacatttgtctgtaaaactgggtgtggttgccgaaagagaccttgcacaagcctgcagggatcacttcagcccaaccaccaatttcatactctgggtattctgtgaaatagccattgctgcctgcgatctcgctgaagtcatcggatcagcgattgccttaaatctgctattccatattcctctgacctggggtattgtcatcacaactgtagatgtgttaattatccttttgcttcaggcgaaaggcttccgttggattgagagtattgtaggcggacttatattcattattctggcctgtttcatgtatgaaattgttatttccaagcctgcgtttaatgaaatcctgggagggttggttccacaaaaagaaattattcagaatcctgctatgctttatattgcaatcgggattttaggagctaccgtaatgccccacaacctgtatctgcacagcagcattgtacagaccagagattatacccgtgatactgaagggaaaaaagaagccataaagtttgccactatagacagtacagtttcactaatgctggccttcttcatcaatgcagccattcttattcttgcagccgctacatttcatacaaccgggaacgaacatgttgctgatattcatgatgcctacaaaatgctgacacccattttaggagcttctatggcaagtattgcatttgctattgctttgctggcttccggacaaaactcaacattaacaggaacgcttgccggtcagattgtgatggaaggatttctgaatatcagattaaagccatggcttcgaagattgatcacaagacttattgctgtaattcccgcacttattgtcgctatactttatggcgaacagggaacaacagagttattggttttaagccaggtaattctatctatgcagctgagctttgcagtggttccattggtaatgttcaccaacgataaagccaaaatgggtgaatttgtaaataaaccctttcttaaaatctgtgtatggattatttccatcattattattgttttaaatctgtatctgctctaccagacgtttacagggaaataaaaatataactatagctttttaaattggctattgggcattgttaggtgaatggtcaatggtcaatttttgctttgcaaagtcaatttttaatgctgaacaattactaattcacaagcgaagcggattgacatcttaatcatcgcagatgaatcgtcaatggtcaattattgctacgcaaagtcaatttttagcgatgagcaataaccaattcacaagcgaagcggattgacatcttaatcatcgcaggtgaatggtcaatgggcaatttttgctttgcaaagtcaatttttaacgatgagcaataaccaattcacaagcgaagcggattggcatcttaatcattgcaggtgaatcgtcaatggtcaattttttctttgcaaagtcaatttttaatgatgagcaataaccaattcacaagcgaaacgaattgacatcttaatcatcgcagatgaatcgtcaatggtcaatttatgctttgcaaagtcaatttttaacgatgagcaataaccaattcacaagcgaaacggattgacatcttaatcatcgcagatgaatcgtcaatggtcaattattgctacgcaaagtcaatttttaacgatgagcaataaccaattcacaagtgaaacggattgacgcatgcaccattcaccggctgctcatttttctgccttaatgtccagattttatatttggcaggctctttgtcaaacaatctgtaaataaatattgaattatggaaaaccaggatattaacgaagaaagcatcaataatcaggaagaaaacaatgttcagaatgacgcaacatctcaggacaatgtgacagctgctccttctgcggaggaacttttggcagaagaaaaagaccgttacatcagattgtatgctgaatttgaaaactataaaaaaagaacgagcaaagagaagatggaattcttccagtatgccaaccaggagatgatggtttcaatgttaggcgttttggatgattttgaaagagcattaaaagaaatcgctaaaaacggaaatccggctgatcttcagggtgtagaactgatctatcagaaattcaagaataaacttactgaaaaaggcttaaaaacaatggaagtaaaggctggtgacagctttgatgttgatttccatgaagcgattacccaaatccctgctccatcagaagatttgaaaggaaagatcgtagatgttattgaaacaggatatacgttgaatgataaggtaatccgttttgcaaaagtagtaacaggaaattaaaattcataaatgataaatggtgagtgataattgatgaatgttttcacttattagctttacaatatcttttatcatttatcaacaatcaattataaaattgtcatgtcaaaaagagattattacgaggttcttgagatcagcaaatctgcatcaggcgacgaaataaaaaaagcataccgtaaaatggccattaaatatcacccggacaaaaacccgggagataaagaggcagaagaaaaatttaaagaagctgctgaggcttatgaagttctgagcgatgatcagaaacgtgccagatacgaccagttcggacatgccggaatgggtggcaatggtggtttcggaggcggaggcttcggaggcggaatgaacatggaagatattttcagtcagtttggagatattttcggtggcggtttcggaggatttggtggtggcggtggccgtcagcaggtgaaaggttctaatttaagaatcaggatcaagctgaatcttgaggaaatggtaaacggaactcaaaaaaccattaaagttaaaaagatgaagatggcagaaggtgccacttcaaaaacatgtcctacctgtaacggttccggtgttcagataaaagtaatgaatacgatgtttggccagatgcagacacagactacctgcggtacatgtcagggaatcggaaaagttgccgataaaattcctgccggtgccaatgcacagggtcttgttaaggatgaagaggaaattacaatcaacattcctgcaggagcaagagacggtatccagcttaatgtaagaggaaaagggaatgatgctccgtttggaggaactccgggagatttattggtaatcattgaagaggaagtagatcaaaccatcaagagagaaggagacaatcttcaccaggaactttatgtttcatttgctgaagctgctctgggaaccaaaaaggaaatccctacagtaggcggaaaagtaaaaattactgttgatccgggaacacagtctggaaagatcttaagattggcaggaaaaggacttccaagcatcgacagctatggtaaaggagacatgttcatccacatcaatgtatggacaccgcagaagcttaccaaagagcagaaagatttctttgagaaacagatgtccagcggagaaatggttgcagaaccatccggaaaggaaaagactttttttgataaagtaaaagatttattcaattaatatagaaaaagagacttttacaagtctcttttttgttttaaagaataaaaaatcctgcactctttcgggtacaggattttttggttatttaattctaattctgttcttatttttttgtcaccagggaataaattgattttcctaaagtaaatactgctactgcagcaatccctcctacaagaccgaaagtaaactctttcagcatagccggccaggttggaagcaattcatgcagataatggatattgtgggcaaaaatacctcctgaaaccagtatcagagcaaccgtacctacaattcccagaagtttaataattacaggcaatgcttttaccaataaatgtccgatcttggaaaagaatcctttatcatgacttttcttgatcaggctgaaaccggcatcatccattctcacgatcagtgctacaattccgtataccccaactgttgccaaaaacgatacaaatgttactgttatgatttgcgtaagaagtgggtgctcctgctgaataacagttcccagtgcaataattacaatctcaatggaaaggataaaatctgttctgatggctgagtttattttcgctttttcagaggcttcgaaattttcttcttcatcactttctttgataacttcatgtccttttttggaacggtgaaacaggaattctataatcttttccactccttcaaaagcaagatagattcctcctaaaatcagaatcatttcaatagccggcttatagagccagttgagcagaaaagcgatgggaagaataatcagtttattgataaatgatcctttggtaatagcccacagcacaggaagttctcttgaagaaagaaagcctgtggctttttctgcatttacggccaggtcatctcctaaaattcccgctgtcttttgcgtagcaatcttactggtaaccgctacatcatccatcaatgctgcaatatcgtctaaaattgcaaaaaagcctgatgccatattttaataattttttaatctttgttaagttcagcaaaaataaatatttaattccgtttttgaattcataatctgacaataattttaaaaattataagactgattaaacaatgcttagctttcaatattttatatctttgtttaaaatctatccgatggatgaaaactgggaaacccaattacaaagtatatggctaaaacttggaacgataagtgatgaagagtttattcagcaaattgaaaatcatgtagaattgcttaccattacggattatcaggctattgctgattttgaaagagcctgtgcttttgactccaccggacatgaaaagaaagcagagcctttgtacagatcagcattagacaagggattaaccggcttacgaagaaggagagcaagaatccagctggcaagcaccttaagaaataacggaaaaacagaggaaagcatccgtattttaagggaagaaaaagtcaattattctgatgagctgaatgatgccgtagattcttttttagcactatctctttcttcagcgggaatgtatgaggaagctttatcgctaaccctaaaggcaatttcacatcatttaccacgatacagccagtctgtttaccgttatgcaaatgctctgtataaagaattaccataatatttctttatttgattctatgaaaaaacttattcgcaggtatcatttttttgtgatgggatgtattggtttcgtgctgcagtcctgcaatacgaaattcagagtctgggtaggccccggaggccagcagaaaatttacaatctcaaatacggtgagcataaaaggcagaaaatggatgtctttcttcccaaaaattatgctgaagatactcctgtcgtgcttatcgttcatggcggggcatggactttaggaaaaaaagagcatatgatccagattcagaagatgctttttgaaaacaggattccgagcatcaatatgaactatagactggtttctgcaaagaaaaaaatcacttacaagcagcagcttgaggatattggccaggtgattgaaaaatttaattcacttgcagataaagctgagcttcaacccgacaattatattcttctgggagagagtgccggcgggcatctggcacttctttacggataccagcatcccgaacagatcaaaaaaatcatttcactgagtggcccaacagattttttcagttcgcaatatcttaaatctttttattcaaaatatacctctcctactatccagaaagtggtaggtaccaaatttgaccgcagcaatgtttctgaagcctttaaggaagccagccctattgcgaacattactaatgtccctacgttgttatttcagggaaataatgatattctggtcaatcagcatcagggaattgctatggattcggcgctcacccggatgaatgttccccacaaatttgtctttatgaaaggagcaggccacgcacccagattcttcagcaaaaggaaaagagacagtattatttatcctaatatcctggaatggattaaaaagtaaagatgtcttacagaatttatttgattattaaacgcaaaggataataattacaacgcattattgtaaggaagcgaagaagtcgtgactttgtcactgacgaagctaacgaatatatatccatacgcttagaaagaatcaattcattgattcctacctttttctttcttaaaataatactcaatacaaattaatctttgcgttttaaaaattcattacaagcaataaaaaaagccatctcatgattgagacggctctatatttttaattgcattgtttatttattcaaagtcctgatcttcgtatttggataaatcttcttttttcccgaaaacaaacttgatgattaccggaagtgtagttaccagtacaatcacgataataatatattccagtttttcttttaagttgattccaaactgctccataaagagcttatccaggtaatgtcctgcaaagatcagaataaacgaccataatacagcaccgataatattatctcttaaaaactcttttttatccatcttcacgataccggctacaataggggtaaatgttcttacaacaggtaaaaaccttgccataataactgccagtgctccatgtttttcaaagaaatcatgtgcctgataaagatatttctttttgaaaagcattgaatccggtcttttatacaaagccgggccggcttttcttccgaaataataccctacttcatttccaataatggctgcaagggatactcctgaagccagaagtgtagtatccaggaaatcgcttcctgtagagccaaaagtctctttgatgatttcaacggcataaattcctgaaacgaataaaagtgaatctcccggcaggaaaaatcctacaaaaagccctgtttcagcaaatacgataaacaaaataagccaaaaccctcccattttaatataaaactcagggtttaataaatccttccagctattgaaatcttccataaatatcgatgaacaacaaaaataggtctaaaatgtctgaaacaaaaattaattataagattttaactaaaattcaaacatgatttttataagtcgaggtcatcatcggaaactgccgtcccatcggccatcaggaatgctttcaggaaaggagtgatattaccgttcataacagcatccacgtctgacgtttcatgacctgagcgtacatcttttaccagcttgtaaggatgcatgacgtagtttctgatctggcttccccactcgatcttcattttattggcctcaatctcgtttctggctttcatacgttcttccagttccatttcgtaaagtcttgaacgaaggagctgcattgctttttctttattctgaagctgggaacgggattctgagttttcgatgataataccggttggtgcgtgacgaagacgtacagcggtttccaccttgttgacgttctgccctccggctccggaagctctcatggtctcaaaactgatatcggcagggttgatattgatctcaatggtatcatccactaaaggataaacatacacggaaacaaagcttgtatggcgtttcgcattactgtcaaagggtgagattcttaccagtctgtgcacgccgttttctcctttcagatatccgaaagcatattccccttcaatttcaagggttacagttttcactcctgccacatcaccttcctggaagttcagctcacggattttatacccctgcttttctgcccacatcgtatacattctcatcagcatagatgcccagtcacaactttctgttcctcctgctcctgctgtaatctgaagaacggcagaaagctcatccccttcattggaaagcatatttttgaattcaaggtcttcaattttctccaccaactgcggaaatgtttcatccagttctttttcagaatccggatcctctttggcaaagtcagccaacacctgcagatcttcaaactgtgtctgaatctcatcatagctttctacccattttttcttggaacgaagctgttttaaaaatgcttcagccgtttttggattgtcccaaaattcaggtgctgcagttttttcgtcatcattggcaatttcaatcttctttttctcaatctgaagatatctgtgtaaatcttcaattctggattgaacttcttttatctggtcgttgttaatcacgaatttttctttttgcaaaaataaggaattcttttagagtggagaggtacgcgcttaaagttcccggtttaaagttttgggttcggaatccgtgtttttaggattcgggattcgatggataaataactattcttttacgatttcagcttcaaagcttcttctaaggtattcttttgattttttactttctgttttgaagcctgccattgttaagatataaacaaaaagtaacatcagcagaggcatgaaaaattctacagacatttttttctctgttgaaccgatcataatgaatatccctactgcaatggagcaccagaatagtaaaaatacaagtacaaatgcatgtagcgacatggtcacctgtatttgggttccattattttcattttgaattttaccatttatctgaggaagaaaagagtttctgtattgtatcactctgcttatttcaaagctattattatccacagatccttcataatcttttatataattttttcccaaaccaaattttttaggttctacaaaaccagaaagtcttgtaaaaacttcctgttcagataaatttgtcctgtaggtaatacgttcaaaaggtaaatatttcatttgtatttaaatcatttttgctatctcctctccaattttaggggctaaagcaactcccattcctgaaagccttacggcacaaaactgtctttccgaaatctgttttacaatgggtgttttttccaggcccattgccattattcctgaccagcggagtgcaattttaaagtctttatgaggaagaacaacttctcttaaaaagttttccaggtgattctgcagaaatactgtcgtttcaaaagcgatagtttcttcggttttaaaatcctgatttctcccaccgcccagcaatattctgttgcctaagttcctgaagtaataatacccttcatcataatgaaaggttccttttagttttaatccgtctataggttctgtcaaaaggacctgtccacgggctggaacgatattttctttttccagaaactttgaagtgaaagcattggtacaataaatcactttaccagcttttacggacacatcgccggagagatagacctcagcatcttctgttctttcttcaatcttcaggacttctgttccgaataaaaactccactttcagttcatggcatttttccagcagcttttgtaacagtttcccagaatgaagacttccttcacaagggttttcgatgagaaattcagatttcccaagtccgaattcttttattttattctgtttcagactgtatgttttatccagtcctgttattgttttcagtttttcattaacactgtcgatatgggttaaaggctcttcattatttataatttcatagtctccttcaagttcaaaatcaatctcatcatttttaaaataatgtcggattttctgaagcccttcaaatctcattttaataagcttcagtgtttgttcccatcccattttctcagaatcagcaatgatttcggtaaggcttccaaaacaggcaaaaccggcatttcttgtcgaagcacctaacggaatagcgtttctttccacgattaagacagatttttcaggatattcctctttgacagctattgcagtccatagcccggaaaatccggcacctatgatgataatatctctttttctgtagaatgtatccagttcccagatgctgttcatgaataataagtaatgagtgatgagtattttttgtaaaaccttaaactttaaaccttaaacattgaacgattaccctttatctcccccgtcattatgctgaaacccgatggctctttgtggttcttccactactctgtaggtttccagttcatttttcaatgcctgaattctgaactgaaaatcatcaaaattattgataatggcatcagccaggaatcttgctacctgatcaagatattcttcagtaagcttggatcctgcatctcttaatgctccgtttaagagattctggtcgatcttcagtttttcgtttctggttttctggtaaaggtttttaatccttttctttaagctttgggtaaagtcgatcagcatggtattgctgaaggccttcatttttgaagagatgtcatgccagaaaggaattttatccgctttgttattcttaagaattttatacaataaagaatcttcctcaagtcctctggtcatcgcataaagaataatttctgaacgctcagaagcattaggaggaaaaacagggatcagcacatcaaatcttccaggtgccagaatttcttcatcaatttctgccacagaattagctgagcccaccatcagaactccttctttttcaaatttgctgatgtaatgcagaatgagttcctgcgcttcaaggttacaggaagcaatatctgtctctgcttttcgctgcatcataatttcatcaaaatcatccatgaaaagaagcattttattttccttcatcatgctcagcagaaaatcactgaaattgatttcattgccatcaatcaatgaagttcccagataatgttttttaacttctttaaactgatatccgatgatttcagcaattttgttggcccagaatatcttaccgctaccgggaggtccgtagaggataattcctgcaggcttgttgattccccagtctttgatctgttgtgggttaaggaacggttccaaaacgctggacgtataaaaaaacagatctctgtatcctatgaaatctctttgctgcagactggttttatgcccgaaataatcatacacaaactgatagtttcctcccagtttgttatcaattccataacttgatacagaagatttgaaaaaaccgttgtcgaaaatattgagattattgtctttaattaccttttcaaccttatcttttggctgtttgatcacttctgcaatctgctccagggttttatttttatcgagatctttttcgtataaccttagaaaatctacattttcacgggcaaacttttcaaaatctttctttacctcaaaagtagtacttatgcagtctaccagttcaagatcaaaatcctggataaactgtttaatggcttctgcagaaacctgtaattcttctgcgagttcaattagcttcataactgttcattaattctatcaaatttaatgcatttacccttaaattaatattgatttttgttaattctgtaacattctctaatttatatagactactactatgtaaaacaaattacatggaaaagattttatcagtaaaaaatttgacgaagaaattcaaaagagttgtggtcaacaatatttcttttgatgtcgaaagaggtaatgtttatggacttctgggacctaatggaagtggaaagtccacaactttcggtatgctgctttcaaccatcaaccctaccagcggcgactggttctggtttggaaaaaagggaacagatccggacaccttaaaaaagatcggggctattattgagcagcctaacttttatccttatttaagtgcggaaaccaatctcaagattgttgcagaaattaaaaacactccttattcaaggattgatgaagttctgaaaatcgttaatctgtacgaaagaagaaaagatgctttcaaaactttttctttggggatgaaacagcgtctggccattgcttctgccatgcttaacaatccggaagtattgattttagatgaacctaccaacgggttggatcctgaagggatcatacagatcagagaaatcatcagcgatattgccaaacaaggcatcaccattattattgcaagccatcttctggatgaaattgaaaaaatctgcagccacgtaattgtattaaaagaaggaaattccatttactgcggaagagtggatgaaatgacctccaataatggatatttcgaattaaaagcagacaacaacacttcccttttaaatgctttgaatgaacttcaatggttttcctccatcaatcaggaaggtgatcttatcaaagctcagatccgtgacgatgcttcaatttcagcttcagcaatgaatcagaagctggcagagaagggaatttatctttcccatctgacgaagaaaaagctgtcccttgaatctcaattccttgaacttgtaaaaaacacgaattaatcatgataaaattattaaaactggaatactacaaaaacctgaattataagccattcaaagttttcacgatactttatttcgctattcttattgctttgcttttcatcggattggttgactttgatgtttttggagggactgttaacttaaaggagcagggaatttataatttcccggaaatctggaatttcactacatggattgttgccttattgaaaatcttcctgggactgattattgttttctctatttcacaggagttcagcaacagaatgttcaaacagaatacaattgacggactgagcagaaaggaattcatcacttcaaaattgctgacaataagtattttcaccattgtttcaacagctattgtattgggaattactttgttcctggggtatcaatactcaaatacaacggaatctgcaaaggtttttgctgaaattttctttatcggaaattactttgtcaagctatttactttcttctgcttcttaatgttcctgtccattttactgagaaaatcaatttttgtatttcttgcactttttgtattctggattggtgaagggattttaaccgctgttgaagtattctcaaaagtaaaaggaatgcaaggtccacaaagaaatgagattcttcagaatgacttttttataacacatcttctgccattggaaagtatgtctaaccttattccaaatccgatgatgagattgaatatggccaaagtgatgggtgtaaaatatgatttccattaccctacagaaagtcttattgcctgtctggtgtggtgtggtatttttatattcggatcttactggattctgagaaaaagagattggtagttttcagtgctgaagattaaaagatttaatgattaaaatatttaaagataattaatgactataactagtcctaaataaaaaggctgccatccggcagcctttctttcacattactttttatctaacaacgggagatattttccgtatcctttactttccatttctgcttttggaataaatttcagagaagcactgttgatacagtaacgaagtcctcctttatcttgcgggccatctgtaaaaacgtgtcctaaatgggcatcaccggttttacttcttacctctactcttgtcatcccgtgggagcggtccattttttcttcaatcagactttttgtaattggttttgaaaagcttggccatccacatccggattcaaatttatctgtagaaacaaacaacggttctcctgttgtgatatctacataaattccttcacgtgtttcattccagtattcgttctggaaaggcctttctgtaccgttttcctgagtgacattatattgttcagcggtcagtttctcctttaaaacttttttatcctgtttttgataggctggctttggaagcgggttggctttttttgccatttcaaaaagtcccggttcaatgtggcaatatccgccagggtttttgtccagataatcctgatgatagtcttctgctctatagaaatttttcaacggaatggtctctaccaatattggtttgctatagttttttgccagcttctgaacttcgtcttttactactgcttcatctgatttattggtgaaatagattccggttctgtactggtttcctctgtcatttccctgctgatctttactggtaggatcgatcgttttaaaatacagatcaatcaacagtttcagatctacctgttccggatcgtattttacttttacggtttctgcaaaacctgttgtatgactcacgacttcttcataggtaggattttgagtattcccgttggcgtaccccacttctgttcctacaacaccacgaatctgttgaaaaaaatgttctgttccccagaaacatccacctgcaaaataaatctctctaacgtttttactatccataattttctcattttctttttttacttccgccacattgggctttgctttcctgaaaagcccggatccagcagcaaatactgcgatacccagaatgattccgagtacaattaatatatttttcatttttacctttttattcattatttattattttgaacgatcatgaatccaaatcctaaaagcataagatcttttacaataaagaaatccgtcacaggcactccgtccactatcttccacattcccggagtagtaaacaggtagcttaatgttgtcaggaaaataacaatcattcctattcccgcatacttcttcagtacagcaaatttcgcactaaatatcaggagtaaggcaatgataatttctatcgctccgataagatttgacactgcctggacgcttatgattttatatacgaaaaaagttaagaaatggttttctaccaaaggttttattgcggatgcttctgtgggggtaaatttgaagataccgatccaaagcaaaataagagctgctccgaaaagggagatgtaatacccggtttgggctaattgatttttagatttctgtactgttccgaccatgtttttaagattttaattaatactttatcgttttcaaaagtatagtcggagcttttttacaatcctgacagaatttttatcagaaatttaacttattgatcattttattcttaaaatcctgaatttcagaatcattaatttcagtttctttcttagaaaaagtctttttaaaagctttatccagaagagccagcttttcattgtacatcctgcaccatttgcagatcatcaggtgcatgctaagcatcctgttttctttggcagaaatagatcgggcattccttttttccatcagtaaagtagcttcactgcacggtaaaaataatatatgtagtattctttttatcattattccttatgattttgaaaaccagttaaactccaggcattctctgagctgcatacggcttctttgcaaaatcttccaaagattagtcgtggaaacattcaattcctgacttacttccggtgcttttttttcttcaatataatacattttcagcaggattttccatctggagggtaattcttcaatacattcctccaatattttattaaaatccgcactgtctaaaagttcatccccttcaccggatacattccagtcagtcagaacatcattatgcttccatgagccggtttcatcaaaaaaatgatcaagcctgacattgggttcggatttatattttttccggtaaaaatctgccactttcctgttcaggatcgccatcagccaggtcgatgcctgacttttcccttcgaaagaatcataagctgagtaggccgcaagaaaaacttcctgaacaacatcctgtgcatcttctttattcgaaagcacatacagcgcccgcttcaaaagcggccctgaatattgctctatccagtttttcaattcttcatcttttgtcataggaaggatttctgtattttctcagatcacaacgaaggtagtaagttaaacggatattccaaaattagattattattgattgttattgccacaaaccttataggtttacgatacatccgttaacccaacccttcaccattcaaaacatagcataaaattattacaaatcgcttaaaaatagtaaatttgcatcttatcaaaatttgatactaagaaaagcaaaagcaatactatgacatcacaagagatacgtcaaaaatttttagattattttaaaagtaaggagcacttaatcgttccttcagctcctattgtgctgaaagacgaccctacccttatgttttccaactccggaatgacgcagttcaaggattttttccttggctacaaaacccctaccgcccctagaattgccgatacacaaaagtgtctgagagtttcagggaagcacaatgatctggatgatgtaggtagagatacttaccaccacaccatgtttgaaatgttgggaaactggtctttcggggattacttcaaaaaagaggctattgcttttgcctgggaattactgactgaagtatacggaattccaaaagaaaatttatacgttaccatttttgaaggtgatgcttcagaaaatctggacagagaccaggatgcttatgatttctggaaatctcatatttcagaagatagaatcatcaacggaaataaaaaagataacttctgggaaatgggtgaaagcggaccgtgcggaccgtgttcggaaatccatatcgacctgagaactcctgaagaaaaagcagcagttccgggaatttcccttgtaaataaggatcacccgcaggttgtggaagtatggaacctggttttcatggagttcaacagaaaggcagataaatctttagaaaagcttcctgctcagcacgtagatacgggaatgggctttgagcgtctttgtatggcacttcagggaaaatcttccaactatgatacagatgttttcactccgcttattgctaaggttgaggagctttcaggtaaaaaatacacaggaatcttagaagatgaaaaagatatcgccatccgtgttgtggtagaccacatcagagcggtttcttttgctattgctgacggacagttgccctccaacggaggtgccggttatgtaatcagaagaattttaagaagagggatttcctattcttaccgattcctggatatgaaagaacctttcctttacaaacttgttgctgttctgcaggaacagatgggaccattcttccctgaaattgaaaagcagggaaaactggttgctgaggtgattaaaagtgaagaagattcattcttaaaaaccattgagaacggtttgatcagagttgaaaagctgattcagcagacgattaccagtaaccagaaagtattaccaagcgaagaagtgtttgaactgtatgatacctatggtttccctgatgatttgacaagaattattgctgaagaaaaagggttaaccattgatgaagcaggtttcaaggcagaaatggagaaacaaaaacttcgttcgaaagccgattctgctcagaaagtgtatgactgggttactttagaggaaagagaagaaaactttgtgggatatgaccagattgaatctgaaacctatattacaagatacagaaaggtagaaaataaagacggggaattttaccaggtggtactaagcagttctcctttctaccctgaaggaggtggacaggttggagataaaggtgttcttgaaaacgctgctgaaagcttccaggtactggaaactaaaaaggaaaatggtcttatcatttctttaatcaatggtcttccaaaagatgcaggtgctttattctatgctaaagtaaacgcttcagaaagaaaaaattctcaggctaatcactctgtgactcaccttttgcatgaagctttaagagatgttttaggaactcacgtggagcagaaaggttcttacgtcggtccggattatcttcgtttcgacttctctcactttaataaaatgactgaagaagaaattgctttaattgaagaaaaagtaaaccataagatcaaggaaagcattgctttacaggaattcagaagtattccgattcaggaagcactggacaaaggggcaatggcattatttggcgaaaaatatggtgacaatgtgagaatgatccagtttggaagctcaaaagaactttgcgggggaactcacgtaaaaaataccagcgaaatcggtcatttcaaaatcacttctgaaggttctgcagcagcaggaatcagaagaattgaagccatttcaggagataaatctgaagaatacttcaaaaaccttgaaaagcaaatcactgagctttcccagttattaaagtctaaagatgtagtaagatccattgaaaagctgatcgaagaaaacacttcattgaaagccgaggtagatgctcttaaaaaggaaaaagcaaaaggagaaatcggggaatggaaaaatgcttatgagcagaaaggcaacaagcagcttcttgtgaagaaaacttctctggatgcaggttctgtgaaagacatcgtattccagctgaagagagaaatcccgtcttcagtaacgattatcctttctgatgcagacggaaaaccaatgattacagttggagtttctgatgatcttgctgcagattaccaggctggcgctatcgtaaaggatcttgcaaaagaaatccagggcggcggcggaggaaatccgggctttgcaactgcgggtggtaaaaaccttgaaggtttagaaaacgcttaccaaaaagctttgaatatttaaaatagaaacctctattataaattttaactccggctgtctcaaaattgagagagccggagttgtttttaccctatctctcctattatattcttaacgcaaagttcttcgtatagaacgtcgtatggaagggagcaaagaagaaaatcaatttcattgattctgactaagcgtgagtaataattatacttccatcagataaagcaaatttcccataaacatctgtgtcatcagtgaaatccgtgggagattaaaataaaataatttaggaaaaggttacacaagcgggatatatgttttatttaacactaaggaccgcaaagaaacatttatttatcttaagtattttcgtttgctaagacgttacactcagctatgaaataattgtatttttttgctaaatgggatgcctttgcgaacgagaaaagcaggaaataaaaactttgcgtacactacgttataatatagtattcttattacgaatattttcatcaaagtctctctatttatatccgttctaattattgactttaccttaacaaatcatcacctaatcttaaactatttgttttatcttcttaaaactcagttaacaccagacctttagttttgccataatcgaaattcaaaaaatgaaattatgaaaattaacaaaactattggagctcttctctttgcttcccttgtatttcaaggttgcaatgatgacaacaacagtaactctgacacgcctgtcaatgacaaaatcaaaattgaaaatttttctaaagaacctgctttcgtttttgggatgcctggttttgaaaatttaaatataaccacacttatttccagttccgatgtgcttccgggttcaccggatttcgttttcggaggacagccggacggaatgggacttatgaaagatcctaattctgacggttacctgatgatcactaatcacgagatcaagcaatctgtatcaagagtatacttagacaaaacttttaagcctgtaaaaggagaatatatcttaaacggaaccggaggaatgacaagattgtgttctgcaacactggcaactccggaaattcatggtttcagtgcgttccttaccgcaggtgaatcaggtgaagaaagtatggtgcatgctttaaacccattggcaccggtatctcaggcagctgataaaacaagagtaaaacctgcattaggaaaggcttctatggaaaatgcagttccgcttcctaaagatgtttctaacggaaaaacttatattattattggtgaagatcagtcttattcatcttcccatcagtctgcaggacagctgatcatgtatgtagccgatacacagggagatctggataatggtaagctgtattctttaaggagaacaaacagcaactatacagaaacggatatgacgaagggaaacagctacgacgtagagtttgttgaaattcctaacgccaaaaatcttacaggagctcagatcaaccaaaaaaatattgacaataacgcgatccgtttttcaagagttgaagatgtagattacagaaaaggggctggaaaaggaagagaaatttactttactgcaacaggagaatcttctgatggtattaatccaaaggctggattaaccatgtggggaagagtgtacaagcttgttctgaattccaataatatgcttacaggaaaattagaagtagttgctgaaggagattcaaatcctggaaataatctgatcaatcctgacaacttatgtgttactgaaaactttgtttacatccaggaagacggagattcttactacaaaaatgccaaccatgactcttatatctggcagctgaatattgctaccaaacaatataagccgtggctgaatatgaagcataatagaaataacactgcatggcagactgcttacaaccagtccggagatcttcagaagttcggttcgtgggaattcggagcaatggttgatatttcagacatcatcggagttccgaatacattctctgtgaatattcactctcatacttggcagcttgataaattcaaaaatcctgacggttccggaatcaatgccaataaagaaggcggacagattgtcatcatcagaaacgtagaaaaatagtttcaaattcttcatatcaaattcaattaaagtatcaatagaaaatctctgttgatactttttcatccttatgaatagactttcaaaatacccgatactcctcttcctgtactctgcagcagcattttttaccctttcctattgtaaaaatgataagcagcagccagtatatgaagatcttggttctgtaaaaagaacgattctcaaaaccaatactgattttgaaaaacagatcaacgagctgaaaacccttgtttccaaagattccgatgaaaaacttcttcagcagaaattccaggatatcagaaaaatctataaaaaaatagaatgggcagtagaatatttccttccccactctgcaaggttcatcaatggtcccgcccttccggaaatagaaatggacgagcatacagagatagaacctgaaggacttcaggttttagaagaaatgttttatccttatgataaaagaaacaaagaggaagtgatcagaatgctcaacaagctcgttaataaaagcaacactataagcactaacttccaggtaattaccatcagtaaagaccaggtttttgatgcgttaaggcaggagactttcagaatttcaagcttagggatttcaggttttgacacccctgtttcaggaacgtttttacaggaaatgccttcttctcttcagggagttaaggaaacgcttaaacaaatttccactgaacgttcaaaagacaaagcattaaaaagtatcgaagctgaaatcaattcagccattgaggttctgaaaaaaaatacagataaaaatacgtttgactatgtcagttttatccctgaccatctgaataaaatcacggccttaatgcttgaatttaaagatcaggagaaaatcccggatgttgaagtaacaaccgctttaaacaaaaatgcagctacgttctttgctaaaaatgcttttaaccccaacgccttcactcccggaaaagaatatgcctattctgaagaaaaagcagcgctggggcatcagctttttaatgataaaattctatccaacaataataaccggagctgtgcgacatgtcatattcctgaaaaggcttttactgacggacttgccaaagcaatgtcccttgaaaattcggaactggccagaaataccccttctcttaactatgcgggatatcagcatggtcagttttgggatatgagaaaggatgatctggaaggacagagctctgatgtgatctccaataaagaagaaatgcatggtgatctgaatgttattcttgccaggatcaatcaggataaaaactaccagacagcattcaaaaatatttatcattcacaaaaaacagaggtttggcagcttcagaatgtattggcgagctatatccggtctctggcgaaattcaattctgattttgatgaatatatgagaggaaataaatcagcaatcacggatgaccaaaagcggggctttaatctttttgcaggaaaagcgcaatgtgcaatatgtcatttccttcctttattcaacggtacggttcctcctaacttcaagaaaacggaacaggaagttcttggagcagcagtaaacggagaaaacaagacttttgaccatgatccgggaagaggtaaatttcatgagacagtttcctcattacagcattcattcaaaacaccaacccttcgaaatatcagcaaaacagcgccttatatgcacaatggcggttataaaacgttaaaagaagtcatgaacttttataataaaggcggaggaaaaggttttggatttaaagtagacaaccagacactttctgaagcgcctctgcagcttacggatcaggagatcaatgatattattgaatttatgaaggctcttgatgacaaataaaacacaattctaaaacacaaaccgcgaaaaacaattaaaactctctgaatcaattgctcagggagtttttttattggtaatctcaggaaaatacagagagactatctaaatcatttttttatttggcttaatccctggaaagtccataaaaacattagattaaatcaatgttatactctgttaaaaacttttctaccacaataaatattattaattttgacctagtttttttacatgaaaaggggtttactgttaatattttttctgatctgctttttggggtattcacaaacaaaaattaaggttgtggatgacgccagtcaaaagcctgtctttaaagctaaagtatcctgtgacaatatgcttatcgggtatactaatgaacaaggtattctggaatttaaaacaggatgcaaaaacattgatattgaagcggactcttatcagaaagaaagccttactgtagagagcagcatggaagtttccctgctgaaaaaaacatccagaaccaccaatattgaagcggtggtgattgaagataaaagtgatcccagagctttggaaattctaaaaaaagtaaacaagctctggaaagaaaactctccgaaaagcttaggttcttattcttacaaatcctatgaaaaaatttcccttgatattgatgaggacagtctttcccagtttaaccagtatttcaatgatctaaacatttttaagaaaaaaagggaaaaagactcgctgaataatattaccgcaagcaaaattttttcaaaaagcaagctgtttctctgggaaagggcacaggagtttttatattccaaaaaatatggtgaaaaaatcaatattctggacaacagaatttccggtctgaagcagcctatctacgaaatgatcgcccttcagcagagcaacagggatgttgtccccgaacaggtaaagccggaaaacagagggctatacagattctttctttctgataccgttacgctggacggaagaaaaaactttgtgatccgcttccgtgaagtgaattataaaaaaccagacagaaagcgaaaatataacggtgccatctacgtggatactgaaacgtacggaatcaaaaaaattgaaaacttcagtaaaaataaaaacgagggaatcattaccagcacctgggtattttacaataacaaatggttccttgcccacgaaaaagccaagctgaaaatgggtaaaatggctatggatgacaaagtgcatgcagatgacaagaaagacaaaaaaagctttggcacctacgctttcctcacttcaaaatattttgatttcgaatctcctattgaagaagatcccaaggatttcaaaggctacactttctcggtaaaaaatattgacggacaatcactggaccgctacagaaccgaagctcttactgaaagggaacagaacacttataaaactattgacagcttaggtaaaaaatataaaatagacaataaagcacagattttgtcaggattattgaacggacagatcagagtgggttccgtagattttgcggtggatgaaattgtgaattacaactcttatgaaggattcagattaggtttaaaagccaagcttaatgagaactttgatcctcatttttcaccggattattattttgcctatggggtaaaagacagaagatggaaatacggaatgggactggacatgaaaaccacactggagaaaaactcttttttcagatttgaggtttacgatgatgtaactgcctccggagagttcaacagaaagctatggaatttcaagatgagaatgatgaacttcgggaataatttgaataacgacagatattttcattttaagggagctacattatcttatctgaatgatgtcaccaacggccttactcttgctcttgccgtaagaagaaataccgaagaagcagaattcgattatcagttcagggacagaggcacttcatacagaaacttcaataccctttttaccctgaagtattctccgaattcaaccaatattatgacgcctcagggaaaatctctgatcgatcagaagtatcctgaactgtacttcaattatgagcagagctacaaattactacagggagattttaattattcccgttttgatgccctctttgttcataatttcaaaacacctatcggaactaccggtttcagactgtatggaggagttgttctgggaggagcaccaatctggaaaaactttacaatgaacggacttgcttctccgggaaaagactttaattttaacctcacttcttaccttgggtttgccaccctggagggaggaaaatattataatgataaattcgtagcctattatttcacgcacaaactgccatggtatttaaaaagcttcggacacaatatttccagctttgattttgtcctgagaggaactatcggagatatgaaacatccggaataccaccagtttaagttcagaaagctggatcacctttatcaggaagtcggtgtggaatggagcaatttcctttccagctatttcaatcttggtgtattctacagagtgggttattatgcaacccctaatttcaaggaaaattttgccatccagtttaagctgaagtttctggaattttaataatcccgatctttacagcagaaattatacattatacattatacattatacattatacattatacattatacagaaatatcatgcagaaaatcgagatcaaagcagaacagttttttgaattattaaaattaaaagacactccgatgtgggagattttctcacagatgattgatggcaatgaaaaagaaattatttttttagataatgaagaaaagattctttttaattatattttaccttctacacaagagaagctggaagaagacaggaaagaattttcaaagcagttttcagagaaattagctaactttaattaaaagtttgtatgaataaaagttatgttttctgcctgttaagcattttcctgtttacccttggaagtgctcagacttataaaaaaccattggtttccgccatcaaagaatctgatcttcgcaccgatatgtatcagttggctgcagaccagttctggggccgtgaagcaggaactctggacgaattaaaagtttccatgtggcttgctgacaaggccaaagaagcaggaatgaaacctgccggagataacggaacatttttccagttttttgatatgtacagacatcaggttatccctcaaagcagccttaaaatcggagataccaacctgaagctatggaaagactttctggtagcagaacctgtgaatgcttctctggatgctgaaatagtgtatgccggaaatgcagaacctgaagatcttgcaaaattgaatatcaaaggaaaagttcttgcggtaaatgcttcagacaaaaatatttctaaggacatgacccttttcgtaagaagatatcccggatttgtaagaaataaatattacaataaagctgctgaactgggagcgaaagccattatttttatcaccgatgatatttccgaacaaagctgggtggaggtactgcctcaaatgacaagaggaagctacggcgtagaaggattaagagagaaaataacgaataatattcctgttttatggatcaaaagagaaaatgcaggctgggtaaaaaacagtcctaaagcttctctaaatctgatcactgaaacctacaaatatccttcagtaaatattatcgggaaaatagaaggtacggatccggtccttaaaaatgaatatgttttgctaagcggacatcaggatcatgacggcatcagacatcctgtaaagaatgataccatctataacggtgctgacgataatgcaagtacatgtgttgctatgcttgcaatggcaagagcttataaaaagcagccaggaaaaagaagcatcctgtttgttttccatggagctgaagagagaggattattaggatcgagatggcacgcagcccaccctgttgttccgaaagagaaaattgtagccgttctgaatggtgatatgatcggaagaaatgacaataatgaagcggctttattaggaggcaatgctcctcacaaaaattctgaagagctcgtgaaaatggctgaagaagccaataatgaaagtacaaaattcaaatacctgaaagattgggattctccgagtcatgctgaatatttctatttcagaagtgaccatcttccgtatgctaaaatcgggattccggcgatatttttcaccagtgtgctacacgaccagtaccacactccgcaggatgaatctgaaaatatcaattataaaaagctttataaaatgactgagtggatgtacagaacctcctggaaagttgctaatgaaacggaacggccaaaagtaattgcgaatttttcactggaaagatagttgatagggaaaaaattgaacccttaagaagaattcagattttaaggaagttaagattcaaattcatttgaatgaaccattttgcttactgaatatcaaaagatattttcttcattattcttttgtcttgaaacaaaagaatcaaaaattcaagacttagaaacttccgctaaaaatgaaatctgttctctaaaaactctaaactcgtgcagaaacagtctatattgagaatcacagattgccccgcactcaaacaatagagtttttttaacgttcacagaattcattttcttaacgcttcagtttcttatgtcatttgacattgtcaaaaaaacaaaagcttcacggattgtgaagctttttcatttcatcattgtgtttttagaatctgattgaatgcgaaataatttatatcgaaagatattttcttcattattcttaaaaacttaattatccttaatggtttaaaaattctttctaattaatatacttcttttgtcttgaaacaaaagaatcaaaaattcaagactcagaaacttccgctaaaaatgaaatctgttcactaaaaactctaaactcgtgcggaaacagtctatattgagaatcacagattgtcccgcactcaaacaatagagtttttttaacgttcacagaattcattttcttaacgcttcagtttcttatgtcatttgacattgtcaaaaaaacaaaagcttcacggattgtgaagctttttcatttcatcattgtgtttttagaatctgattgaatgcgaaataatttatatcgaaagatattttcttcattattcttaaaaacttaattatccttaatggtttaaaaattctttctaattaatatacttcttttgtcttgaaataaaagaatcaaaaattcaagactcagaaacttccgctaaaaatgaaatctgttctctaaaaactctaaactcgtgcggaaacagtctatattgagaatcacagattgtcccacactcaaacaatggagttttttaaacgttcacagaattcattttcttaacgctgcagtttcttatgtcatttggcattgtcaaaaaaaacaaaagcttcacagattgtgaagctttttcatttcatcgttgtgtttttagaatctgattgagtgcgaaataatttaatattgaatatgattttttaaataagcaggttcatcagcgcaggatcattgttcagatagttgacaaagaaatcatattccttcattttacccatcaaaggaggaaaatctctgttttttttcaacgcaattcccaccactgcaattcctttttcttttgaatttttttgggtgtattcaaaataggtaatatcatcgtccggtcccagcacatccattacaaaagtttttaatgctccggggcgctgtggaaaccttacaaggaaataatgctttaaccctgcgtgcagcaaagccttttccttgatttcttccatacgcgtgatatcattgttgcttccgctgataatacacactacatttttaccttttatctcttccttatatttgtccagtgccgctactgaaagcgctccggccggctctaccacgatagcgtctttattatataatgacaatatggtttcacagactaatccttcgtcaaccgtagccatatcatgcaggatatttttacaacgttcgaaagtaatttctcccacctgctgtacagctgcaccgtctacaaaacggctgatcttttcaagaagaacgggttttcccttttccagggcttttttcatacttgcagccgctgaaggttctaccccaataatttttgtttggggagacaaatactgaaatacagtacagactcctgctgccagtccaccgccacctatcggcacaaaaagatagtcaaccataccttccgcctgttccaggatttccaaagctgttgtagcctgtccttcaataatcgccgggtcatcaaaaggatgaataaatacgctgtcattctctttgcaaaacctcatcgcagcgtctttagattcatcgaatgtgtctccgaataaaataacatcaatgtattctccaccgaacatctttacctgttcgagcttttgtccgggtgttggcaaaggcataaaaatcgttcctttcactttcatggtatggcatgcaaaggccactccctgcgcatggtttccggcactggcacatacgactcctctggacagttcttcctgtgacatggttgccattttattgtatgccccccttattttataggatcttactctttgcaggtcttcccttttaaagctgatgtttgcctcataaatggctgacaaattattattgacagccaaaggtgtttttaccactacatcttttaatcgttcctccgctttatagacatgctctaaaacggaggaacttacttcctctttcatcatccttaagtaattaattgttttcgggtctcaggctgcgcacagtcttaccggctttccacatttcgctttctctcagctcagtaagttctgcttccagtttttcacgataatccggtttactgttgctgtcaatcgagcgttgtgcctcatttcctttagctacattgtcatacagctcttcaaacaaaggcgaagtagcatccctgaaacgcttccaccagtctaaagcacctctttgagcggttgtgctgcagttggcatacatccagtccattccgttttctgccactaaaggcattaatgactgcgtcaattcttctacggtttcgttaaaagcttccgaaggactgtgtccattttttctcaatacatcatactgagcggcaaatattccctgtacggcacccatcagtgttccacgctcgccggcaagatcactgtatacttcttttttaaagtcggtttcaaacagatacccgcttcctattgcaattcccaatgcggttactctttctctggcttttcctgtagcatcctgatatacggcaaaactgctgttcagacctctgtcctgcagaaacattcttctcaatgatgttcctgaaccttttggtgctaccagaaaaacatctacatcggctggaggaacaattcctgtacgctcattgaatgtaatcccgaaaccatgtgaaaaatacagcgcttttcctggggtaagatgctgttttacttttggccagtattcaatctgtgcggcatcactcagaagatagcagataatggtacctttttccagagcctcttcgatttcaaataatgtctctcccggtacaaatccgtccgctactgctttatcccatgatttggagctttttctctgccctacaatgacattaattccgttatctttctggttcaacgcctgtcctggtccctgtactccatatccaataactgccacgacttcgttttttaatacttcctgagctttttccaacggaaattcttctcttgttactacattctcctctactcctccaaaattcaattttgccattttttttgattttatttattactgattatgatgtttaatttctgagcttagctcgcatgttctactgccgtcaggtaaggatttctatgataatgcacttccagaacatccacctgtttttccatctgtctgctgattttctgaacagaatcttctgtttccctgatcacgatgacaaacttttttactttttccatttccgaagggcctacattaaaggtcaccatagaaattctccttcttgaaaaaatagcattgatgcggctgatcaatcctaaataatcttcggtatacgctgtaatcgtatattctttatgatctgttttcatctttttattttttaaactttattattgagtacaatctccgaaacacttttcccctggggaatcatcggaaatacattgtgttcttttcctgtcatcacttcaagaaggaaagcgccttcatgatcaagcatttcacggagggcccatttcagatcttctctttcagaaaccctgtttccctggatattgtatccttttgctacctgaacaaaatcaggactctgaatatctactgaagaatatctttcttcgtgaaacaattcctgccactgtcttaccattcccagatagcaattattaagaattaaaatttttacctccggatgatactgcataatggttcccagctcctgaatattcatctgtgctcctccatcacccatcactgcaataacaggccggccggtttccgcataggatgctcctattgcagcgggaagacagaaccccatggttcccaagcctccacttgtcacattggttctggaatgtttgaagtgagagtatcggcatgttgccatctgatgctgtcctacgtctgtcacaattatagcttcaccttgtgtcatttcattcagataacggatcacttctcccatggtaatctctccttcatcgggataaagctctgtatgaatcagattgatgctttccacttcgtggcattttttaaatctttcatgccaggcatgatgttctctttttacaatcctttccgtaagaaggggaagggtatgtttgcagttcccaagaaccgggacatcaacttttacgtttttattgatctctgctttatcaatatccagatgaataatttttgcctgttttgcgtactgatccaatcttcctgttacacggtcgtcgaaacgcattcctacagcaatcaaaacatcacattcgttggttaatatattcgggccatagtttccatgcattcctaccattcctacagcctgcggatgattggtaggtatggcactcattcctaaaacagtccatgctacaggaactcctgatttttcagcaaattctaaaaattctttttctgcttttcccagcataattccctgtcctgcaataataaatggcctttcagcctcatttattaacgatattgccttttcaatactttcaaaacatggttcgggatccggtttatagcttctcaatgaatggcatggagtatatcctttataatcaacagactgaagctgggcatttttagtcacatcaatcaatacaggaccgggacgacctgacttagcaatgtaaaatgcttttgccagtacttcgggaagctcattggcatcagtaacctgataattccatttggtaacaggacttgtaacgttcattacgtctatttcctgaaaggcatcggttccgagaagatgttcaaaaacctgtcctgtaatacagaccaaaggagtgttatccagcagcgcatctgctaatcctgttacaagattggttgctccgggaccgctggttgccagcactacccctacttctcctgatactcttgccagcccctgtgccgcatgtactgctgcctgttcatggcgtacaagaatatgtttcagtgtttccttataatcgtaaagggcatcataaataggaataatagctccacccggatatccgaaaacggtttttacaccttcctgcagaaatgcttcgagaatgatccggcttccggtaagttgtatttctgttgataaattcaggttttccatatacttttattgagtgatttcgtccgttacacagccttctgcagctgatgatactgttaatgcatatttataaagcaatcctttctgtactttaaggggaggtttttgccaccctttttttcttctttctatttcttcttctgaaactttgagctgtatggtattgtttaccgcatctatttcgatcaggtcatcattgtgtacaaaagcaatcagacctccttcatgggcttccggtgtgatgtgtcctacaacaaaaccatgggttcctccactgaatcttccatctgttattaaagcaacactgcttcccaggccggctccgatcaatgcacttgttggcttcagcatttccggcattccgggagctcctttcgggccttcgtgacggatgacaataacatcaccgtgctgcactgttccatcctgaattcctctgatcagatttttttcgccatcaaacacacgggctttccctacaaagcgctcaccttcttttcctgtgattttggcaacacttcccttttccgcaaggtttccatacaatattctcaggtgtccggtagcttttacaggttctgaaagtggctttataattttctgagtattaaaatccaatcccggaacatctgccagattttcggctactgtttttccggtaacggttagacagtctccatgcagtaatccctgttccagcaaatatttcatcaccgccggggttcctccgtgttcatgcagatcctgcatcagatattttccactcggtttcaggtctgccaataccggagtatgatcgctcatcttctggaaatcgtcctgagtaagaggcaccccaacactttttgccatggcaataaaatgcagaacagcatttgtacttcctcccaaaataacaataaggcgaagtgcattttcaaatgctttacgggtcatgatatcggaaggtttaatgtctttttccagtagtactttcaggtattttcctgcctcaagacattcttcctgtttttctttgcttaaggccggattggaagaggaatacggaagactcattcctaatgcttctatggcagaagccattgtattggcggtatacattccaccacatgctccagctccgggacaagagttcttcaccacaccgtcgaaatcttcttcagtgatttctcctgcaatctttttccccaacgcttcgaaagcagaaacaatgttaagtgcttctcctttgtaacaacctggtgcaatagttcctccatacaccatgatggagggcctgtctagccttcccattgcgattatggttccgggcatatttttgtcgcagcctggcagagcaatcagtccgtcgtaatactgtgcgccgcagatcgcttcgatgctgtctgcaatcacatcacggcttaccagggaataacgcattccgtctgttccgttgctcattccgtcacttacgccgatggtattaaaaatcaatccggctaatccatggttccatgttcccttttttactacctgagcaagatcattcagatgcatattacaggtgttcccgtcatagcccatactggcaattcccacctgggccttgtgcatatcttcttctgtaaatcctatcccgtacaacatggccttggcggcgggctgttcactgttttgcgtgaatgtttttgaatatttatttaacatatttatcctgcattttctattcttttcttctctttaaactgaatttttttactaaattttgattcaaaactacattttgtaatattcttttcattttcagtttttctaaaaattacaatattcaaccgtttatgaaatacatatatttgtctgattattaaatatttaaatcttaaaaatttacaatgacagaactcttaccaattttaaatatgcctgctgtactcttccgctcgccgtgtcttcccagtttcttgtaaaaggaatatcatcaagtgaatccaaagccacaatttctgctgcagtaccacagaaaaagccggcatctgcaccacgcatttcctctggtttaaagaaggtttcttttaccggaatatcaagctcattacaaatctccataacggtttgtcttgtgattcccggaagaatacttcctttggccggtgtatacaaaaccccatctttttcgtagaagacattggcccctgaactttcagcaacatttccgttttcatccaacaccagcgcttcatcatagcctttgtctttggcatcctggcaggctaatattgagtttacataatgtcctcctaccttcgcctcaaccttgaaagctttaggattaggacgttgaaaaggggaagtcataattttcattttatctgccagatatccattattccattcccaggcaagaagagacaggtaagatttctgtccttttgaaagcgacatattgggagagcacgttaccaatggccggatataagcgtctgtaaacccattccgttccaaaagttcataggttagatctgtaagctgatctacagaataatcgaagggaatgtgcatcagttctgctgatcttttcagtctttcataatgttcttttgctttgaaaatcctggttccgtgatctgtgttgtaagatttgattccttcaaaaaccgaatagccatagtgtaaggattgtccataaagatctgttccggcatctttcgctttcataaattttccgtcaaaatagatggtcgtgtcgtcgttgtaatacatgttatagagattaaaaaaaattaacaaacgggaataaaaaaagccctctcacagtgtgagagggctcaatatatgtacagtcatacatcttccttctcacaatcgcaagggaataataatgacgataataattactgataataactgatacatactctgtattctttaaaaattaaaacaaaaaagccgtttcaaatatgaaacggcctatatataatttaaattaaaatctgtttaaaatgccgtttccttactgttgttaatgacaacagcaataatagaaatgacaataatatttttctgattcgtaaaattcatactgcaaatgtataaactttttaataacccacaagtttttttgacactttttattttctctgtaaaaaacggttcaacgtttcctttgcctgagcgacatcatgaacccttacaatttttgcgccctgctccagcactttcatatgaagtttctgggtttcttcattaatgtccaaaggggatttaccaagaggcttataaataaatgactttctggaaatgcctatcaacaaaggaaatctcccaaatcccagatattcaacttcgtcaatcattttcatctgatcttctactgtttttccgaaaccaaaaccgggatcaagaatgatatcgttcactcctttttctaaaagttcttttgttttttgagaaaaataccggttaacttccagcgtaatatcttcaaatctgattttatcatgcatggtttcataagacggatttacatgcatcaggatataaggaagttttgtctgagctgcggtatcaaacatttctgcatcatactgtccgcctgaaatatcattgatcagatcaatcccttcattgaatccgaatttcactgtttccgcataaaaagtatccagtgagattagaacttccggaaactcttttttaatcagagagatcatatttccgatcctgttgatctcttctccggcgcttaaaaattctgcgttgggacgtgtggactgcggcccgatatccagtatttcagctccttctttcaatagtttttcagcatgttccaacgctgatttttcattattgaattttccaccgtcagaaaaagaatccggtgtaagattgaggattcccatgatctttggagtgtccagctgtactaatcggccgttacagttgagtgagtaggttggtgagttggagggttggagggttggagagttggaaagcatggatcgtaagatttataattgattgatgatgattgatgaatgattttgtactgcaaaattagtgatttatagtttttaagagatgaattggggctggaagttggaagatggaagctggaagttaggccaaacacttccaccttaccctcaaatactcccactcttaaccacgtatcccgtatcccgtatcccgaaactctcaaaccctcacactcacaaactcagcttatcaaattcaaaaatctgaaaccgaattcgtatatttggaagattaagaaaatttatgctaaaaacatcagtacagttcgggaaagttatcagtcagtgccgtgatcttttcggtaaaaaattacaggattacggagcagcatggagagtgttaagaccaagctccattacagatcagatttatataaaagttaacaggatccgtacgctgcagatgactgataaaaaaatggtagatgagagtgaggaggatgaatttatcgcaattgtcaactattctattattggactcattcagcttgagaagggtctttccaatgattttaatgaaaacaaggaagaaattttaggtttgtatgacaaatatgccaatgaagcaatggctttaatggaaagaaaaaatcatgattacggtgaggcctggagagatatgagaatttcttctattacagatcttatttaccagaaagtattaagaaccaagcagattgaagataaccagggacagaccatcgtttcggaagggcttgatgccaactatttcgatatgttgaattatgcggtcttctgcctgatcaagttttcagaaaaagaaaatcaattcgaacccaaaaatatttaatatgatcaaaggtatattacgctttattattgctgttatttttatcctgtcaggctttgtgaaagctgtggatctgctaggtttttccttcaaaatggaagaatattttgctcctccggttttcaatatgccatttttagaaaggtttgccctgctgttttccattatagtggtggttatggaacttttcctaggatttatgctcctgcttaaattaaagcttaaatttaccttatctgtattaattgccctttgtattttctttggtttccttacgttctattcggcttattttaatgtcgttacagattgtggatgtttcggcgacgccatcaaatttacgccgtggcaaagcttccttaaggatgttgttcttcttgtaggattgatcattttattcatcttatacagaaaagaattccgtaaaaaagatgcctatggagttacctcaaaagagtcttcaaatacagtaaaatatgttctgttagcaatattttctctgggtatgatctatgttatggcacaaggacttatgcatgagcctatcattgattttcgtgattataaaatcggaacagacatcaaagccgaaaaaattaaaattgacaagaatccttctgaatataagactttctattctctaaaaaatgagaaaacaggacaggttgtaaaagtaaatcaggatgattatatcaaaaaaacagaatattgggctgaaggttctccatggaaaattgaagatggaaaaaatgaatctgtactgatcaaggaaggttacaagtctgaaattgtgaaattcaagattgaagatcctacaggagtggatgtcaccaatgaaattattaatgctccaaaggccgttctggttttctcttatcatccaaaggatgttcctgctgacctgcttcagaaagtagaagcaaaagtaaatgcccagaaaggagctcttatttatggagtttctactgaacctaacactttcaaaaccattaaaaatacactgatggacggaattgccatcaaaacaatagcgagaagcaatccttttgtactgatccttgaaaacggaaaaattgtagataaacagcctgcaaaggactacgttaactaattataaatgatgaatgatgaatgataaatgatctttttgacgaggctaatcgtgaatcaattatcaattatcaattatcaattatcaattatcaattatcaaatttaaacactaaacttaaacatataaaagcacatgcaaaaatcaaataaatcaatcgccggttatcacttattaatgatcctttcttctgttgacggagagtttgctcctgaggaaggaatgctggtacaacaatatctggcggatgaattcccgttcagaatgaatcttgacaacgaactggaaacgctggctcttttacaaccggaagaatggaaagaccattttgaatttcatgcaagatgttttcatgaagattctacagaagacgaacgtaagaaatttgtccagtttgccaaatcgcttatcaaagctgataataaggtaactgaagaggaacatacattctatgttttgctgaaaaacctttggggattgtagcctaaacgaaaaataaataaatcaatcaatatataaatcttatgagaagaaaaatagttgcaggcaactggaaaatgaacaaaaatgtaattgatgcacaacaattaatgattcagttactaagctataaaaataataacgctaccaactgtgaagtttggatcgctcccccttcattatacctgatgatggcgaaagacatttttgaaaaggatgaaatcggtgtattttctcaggatatgagcgagcatgaaagtggtgcttacaccggtgaaatttctgcagatatgctggaatccatagatgctacaggttctttgatcggacattctgaaagaagacaataccacggggaaactgattctcactgtaacagaaagatcaaactggctcttgataaaggtcttattcctgtttactgcaatggagaaactcttgagcagagaaaggcaggacagcaccttgaagttgtaaagaatcaaactgaagtagcgcttttcaccctttctgctgaagaaattaaaaaagtggtgattgcttatgaaccggtttgggctatcggaactggagaaacagcaagcccggagcaggctcaggaaatccatgctcacatcagaaacattattgctgcaaaatacggacaggaagttgctgatgaggtttcaattctttatggaggttctgtaaaaccagacaatgcaaaagaaattttctctcagccggatatcgatggaggtctgattggaggagctgctttgaagctggaagacttctctaaaattattgaagcttttaactagaattcattgatctaaaataaaaacggcggaatcttcgattccgccgttttctttaaaaaaatctaattattgaatatcgactacatacatagttcctttgtctactttacctgttttaggtaaaattttggctttggggtttccgtttccatcatccaccactccgaagtcatcatcattgaaaacagccagtttattgtttcctaagtaaacaattccctcaaatttatcgtgctcatagcccagttttgctacaagatccaccgccaatgttttggtaactgtttttattccggcattcgtaatttcatcccatgaacactgttccaaagcttttccattcactttcattccgtccacggcgttaatatctggtccgtttacatccgttgcattgctcagattgattctgtaaacttttttgattcctccctgagatccgaaatttccgtctctttcaatgactaagaattcactgttgcttattgctgtaatatcacacactgaatcagaagctcctccttcctgtttatataaaaactgtttagtctgccctgtaaccgtatcaaatgtgacaattctcgttaaagttttattggttgccaatgctttgctgggcacatacatcatagactgtatggttcccaccaatgttctgccgtccggagtcatacaaagtccttccattccacggttggctcttctttttgccaaaacagccggtaattttcttggccctgtgtctacaccaaccggacttatcctttccatttccattccatcagcactgtaatgtacaatgtgcggaccgtactcatcagaaacccagaatgtaccatcagctactgctacaatactttcactgtcaagaccgtacttatcagtacctaaaacatttcctgaagcatcatatgcagtctctcctgtacttcccattcctgcagggtttggaagtccggtaataggctgtccgaaaggatttttaagcttgatatatttgattacctcaatattcccgtctgcattgattttaaaatgcataatggttggggtaaagttaggggccaggaattttttcccgtcctggaaatcagtattgggacctctgtctgtaatgacataaaattcaccttttcttgtaggatgagcggctgctccggagccaaatccaccattgataacatctactccgttgatcgtagccagctttgtaaatggaaattcctgaggtagtttggaataattaatatcctgattaattatggttgtatcatcgtcacttttacatgaagccaatacggtcagcattacagcagaccatagtaattttttcatattcacttttatggcagcgaaaatagagattgattataaactgatcttgaatgtaatgataattgtattttaacaatgttgagtgattgtcccatttaaaaccaccccgtcaaaaattttttaggttttgccaatctgcaggatgggaattcttacatcttcaactgcagattgctacggaatgacacaattgaaataatggtttatccattcagtttgtcattttgtaggactctaaacttaaaacttaatccaacgaagaagccgcaccagattggtgcggcttcttatgattttaaaaatcaattattttttctctgtagatctttgtaaaacctcatctaccattccgtagccttttgcttcttcagaagtcatccagtaatctctgtcagaagatttttctacccattcataggtttgtcctgaatgatgagcgatgatctcataaagctcctgcttcaatttcaacatctctcttaagttgatctccatgtcagaagcaactccctgggcacctcctgaaggctggtgaatcattactcttgagtgcttaagtgcagaacgttttcctttttctccggcaaccagtaatacagctcccattgaagcagccatacctgtacagattgtcgctacatccggcttaatgatctgcattgtgtcataaatacctaaaccggcataaacgctaccaccgggagagttgatatagatctgaatatcttttgatgggtcagcactttccaggaataaaagctgagctgtaacgatgttggctacctgatcatcaatacctgttcccaggaagataattctgtccatcatcagacgggaaaaaacgtccatctgtgcaacgtttaatcttctttcttccatgatgtacggagtaagattcgttggtccatacattcccatatactgatcggttaccaaaccgctgtttcctaaatgttttacagagaagtctctgaattcctttttaatgtccatatttctattatgtattattttttaaatattctcaaagtttaaattacaatatttattcctaaaattttataggactttttgtcacagacttccaaaaaaatctgactttaaactatctctttctatcaacataaattcctttgataggtgaatattctatgatgttactcaaccggatagaagcctgtttcagcaaagtgatctttttgatcagctcgtaatacttgatttcatccgtattgctgtactgatcaagttctttagctgtttccttgatcaaatagtcaatatatctgtatttatgcaataaaatatcgcctttgatctgatctgccactttatctccgtaattgggaggataaatatttctggaagcccagttttcaagctcgtccagcggaatcagagcatctacaactttcgtggtaatctcttcatccataaaagatacaaaaaagttcccacttctcagctcatctttttggattccttccctcacctggttgataatgatctcattttctttaactaaaaatgtatattgttcttcttcgaaatggtgaagaatttcttcaataacggtaatctggtattcctcattctgctcatttcttcttttcaggataatatctccgaacatcaacatgtggtccaccaatttattctccatgaataagacatcatacagaaaagggtcttctttttcctgatccaaaggaacaatctccatctttggagctgctttctccttctgctgttgctgaacatgatgggtctgattctgcgtgatctgcttctggacatccagttcattgaaaagactctgttccgaaagtccgaatttattggaaacctccttaagataaacttctcttttcagggcattctgtacaaaggaaactgattttacaatatcccttatcgcttcagcctttttgataggatcgtttcctatatcttttaacagaatttccgctttaaagtcgatgaaatccatcgcttcgttttcgatatacttttcgacatattcctgcggatgttttctggcaaatgaatccgggtcatctccatcagggaaaagcaatacacggatattcattccttctgtcagaagcatatcaatacttcggaaactggctttaatacctgcattatctccgtcaaaaagaattgttacgttttccgttagtctcttaatgagtttaatctgctcagtagttaaggatgttccggaacttgccacaacgttttcaattcccgacatatgaagcgaaatcacatccatatatccttccaccaaaagacaggcattcttccttgaaatggcctgtttactctggtttaatccataaaggacatttgatttatggtagatctccgtttccggtgaattgagatacttcgctgttttgacattatttttaaggattcttgctccaaatcctaatactctaccggaaaaactgtgaatcgggaaaatgaccctttccctgaaacggtctacccctgcaggcgtattttccggaaaaatagaaagtccggatttttcaagaatttctttagtgtatcccttttccagcgcatatgccgtaaaagcattctttttctcaggagaatatccaagctggaattttttaatgatgtcatcccgaagttctctttctttaaagtaagaaagtccaatgctcctgccttcctgatcatcccaaaggatttcctgaaaatacgtattggcaacttcatggattttatacagcaaatctttttctgtctgggcattttttgcttcctcagaaatgtcacgctggtcttcttcaatttcaattccgtatttttttgcagcgtggcgaagtgcttcaggatacgtaaagttctcaatttccatcaggaaagagatggccgttcctccttttcctgtagagaagtctttccagatctgcttgctggcagaaactacaaaacttggtgttttttcatcatgaaacggactgagtcctttgtaattagaccctgcccttttcaactgcacatactcacccacaatctcttcaacgcggatggtggagaatatcttatcaatggtctgcttggaaatcatagtgtaaaagtaagatatttcttttcctttaacaaaaaagaaattctacatttttagtttatgatatttcacaatacctcaaaactcctgtgacattcttcaataaaaaaggccgggaatttcccggcctaaaaacacataatacaaaaattaatcctttatgaattttatgctttgttttgtatttttataatcaattataaccacatagtttccttttgcgaggtctttagtatatctgcctaattctatatttttttcactttttgcctctaccgtatattcgttcatcaattttgatgcatagttgtagatcttaacagaaatatttcctgtcagctcagttttgcttataagctttgaattttctacaacaggatttgtgtcaagggcaaatacctgatctttcttaacagattcaacagcattatcaagattattttcctcggttgatacaacaaaaccactcaataatgttctttttgtattagttcctatccgggcatttaacctgatggaataaactcctgcctcttcattgctgacatctgccaaaaatctgttatcctgaaggttgaattttgcatttacagatttttcctttcctctctctcctttcaagcctgatattcgataaaccgaacttttgataaccactttatcaagatcatctgaagtaagtttaggaaaagatacttccagataggtttttccgttttctttaataactttatactccatcggattatctattccgtcttttactaccgcaataaactcagagttgctgctaagcttaacttgtctgttttccaaggtataattggatgacaacaggtgattttctgtattcctgttatcttttgtttctggcctgatctggttaaaaacctttccagtcattgggtctgtaatatctactgaggcatctgaattttttgtaataatttcaaactgaatatttctggcattcttgcttagctgtaagttctcaggttcttcgcttgaaattaactgataattgctgacagctttaaattctttactttcattttgcagtgatctaccggaaactcccgtattaaccaccagcccgtctaacaccggtttaatagcttcatcccagacatataccccttccatgatatctatatgattgatatatcctctgagatcagtatccgtcattaactgttttgctcctggtcttgtagaactgtaaaatggagttaccccatcattcttaccacctcctaaggcagcaattgcagttccagccggtataattgctggagaaagcagccctgtcaacctggtatatccccaggctcccaaactataaaatttttgaggctggttaagaggatgattgtccatataaggtctgaaataggtttcacagtaataggtagtggataattgtgatcctgttcctaatcctaatgcccctgttatccattccaatcccgggtagttagcaaaatctgccagctgagttccccagtgaggagtccctaaagtaatcactttatctattttatttactttattatattccagcattgcaacatctgaagcttttcctccattactatgagcaataatggtcattgtattcgcattcaaatgattccctacctaatcaatagcacgagataaaatctcaccattttcccaatctccttttaatcggctggtagccacaaaagcagttttatacccttcctgatatgctcttttatacattgagtttccaataagtaaagatgctgtagacattacaaaaccgtgggtaaaaagtatagtcttcccattgtagttaggaggtacacttccatataaaatgttattctctccaagactgttaagataattcagagataataaatgaggtttcggcaaagtagcatacggaagatgttgcgtaaaaaacttacccgaaataataagtaaacataaaaacagaaattttttcataacctaagtgtttaaattgttatcagtcttaaaattaatacactcaactgtgagaatcactaatatttcacaaaaattatcatgcaacacatacaaaaaccatctaacaatcaagcacttaaattaaataaaattcgtataaattaatacgttaacaaaaattaacagaaaatacctggcgattaaaaaagaaaataaaataagaataagcactttatgaattttatacttttctgtctcatctcaatcaattaatattgtaatgcatttataagttctgattcctgatatagtaaacttatcatcagaaaataaagctgctttttgttaccggctacagataaaaataataatttagaagtaaatttgttccatgaaagtaaactcttataatgaatgggaacagatcgttgaacagatcatccctcaattaaaacataacattctccttttaaaagggaacctgggtgcaggcaaaacgacgtttacccagtttcttctaaaaaaactggaaagtaccgatgaagtgaactctcctacctactccattgttaacgaatataatacccccaaaggaaaggtttatcattttgatctgtaccgtctgaaaaacataaaagaagtatatgatatcggtattgaagaatacctggacaattcttttttatgcattatcgaatggccggaagtctatgaggaagagctttacgggctcaactaccacacaatgagcattgtgaacacgggtgaaaacagagaaatttcattcgattaaatattatgtatctttgctcattaattgagtgtaaaataacaatctgtaagacataatttaatttaaggatgagtacaaatatttttactcctttcacagaagaagaattaatgccgaaagaggaaaaattggaggttataaaaaaaggaaaacagttcagtattgggattcctaaagaaacctgtctcaacgaaaggagaacctgcattactcccgacgccgtacaggtgctggtagagcatggccatgaaatcattatagaatcaggggccggacaaggttcattttttacagatttacaatactctgaatctggagcaaagatcaccaatgatcctaaagaagctttcgggcaggatcttattctgaaggtaaatcctcctacagaggaagaaattgaatacatgaaacccaatacctatctggtttcagcacttcagatcaatctcagagataaggagtatttcttaaagcttgcagagaaaaaaataaatgctattgctttcgaatttattgttgatgaatacaaacagctggctttagtaagattagtaggtgaaattgcaggaactgtttctattttatatgcatccgaattattagccttatccaatggtttaatgcttggaggaattacaggagtaagaccggcagaagtagtagttctcggagctggaattgtaggtgaatttgcgacaaaagcagccattggtttaggagccagcgtaaaagtttttgataattctttatcaaaactgagaagacttcacactattgttgacagccgtgtaccgacttccattattgaccctaaagaactcagcaaaagtttaagacgtgctgatgtagtgatcggagcactcccaagactgaatatgacgcctatcgttactgaagatatggtcatgaaaatgaaaaaaggcagtgtgatcatcgatatcaccatagataacggtaaagtgattgaaacttcagaacttaccaccatggaagatccttacgtcatcaaacacggtgtcatccactgcggacttccgaaccttacctcaagaatgccgagaaccaccaccaaggcgatctcgaacttcttcctttcctatattttaaattatgacgaagagggcggctttgaaaacatgctgatccgcaaaaacgaaatgaagcagagcttatatatgtacaagggaagacataccaagaagatcatctgcgaccgtttcggacttacataccacgatatcaatcttttaattttctaatgaagaaactgaaattttatgcaataggcttcgtaccggggcttctgattgtattttttattttgaacaagaagggagcaagctgcagcggctacttacccaacagccgtgttattgcagaaacactttccaaggaattcaaatattctgatgaggctaaaaatgccatgaaaacctacaagattgatgaaaaatttgtaaaagacagtatcattaccaacggaaaagtggattttgaccgcagccatgctcagaaaaaaccatgtcctgactatcttttaacctatcctgaaaaaaatccgtcttacgagatcacttttgaaaaatgtgaagaaagtgtgacagtaaacggtctgaagaaactcaaatagttttttataatcctacattatggaaggcaattactacatgattcatgattatctgatattcatcggagtttttgccattttcctgtttctgacaacaagtatttacctcttcagccaaaaccacaaactgaaacagaaaaataccaaactatcagaaaccaacaaacttattgaacaacgtctgaatgaagtccgtctggaacacataggtactaagctgaacccgcatttgtttaaaaacattctcaattcagttcagtcacatgcctatcagacgtatatgtcactggataagctggccaatgtgctggattatattttatacgaaagcaacaataagtttgtcagtcctaaagaagagctcaattttgctttaagccttattgaaattaataaaatcaagatcaatcccctcttcgacttcagaatcaaatccaggatcaacaagacggattccgtatatgaagaaaaagtatttgccccgttgatttctgtagaccttattgaaaatgctttcaaacatacagattttctcgcccaggactctttcatttctatttacatggagcttgaaaacggaattttcaccatgaaagtaagcaataaagcttctttaaaaaatattctggaaaaagaaaaaagcggttttggaagccagtcttttgatcaaaggcttaagatgatctacagtacgtattaccagcttgaaagaagctcaagaaacggagtttttacagcagagttaaaaatcaatttaggagaattttatgataaaatgcgttattctggatgacgaattactggcgatcagttatttaaaacttctatgcgagcagatcgaaaatgtagaagtggtaaaagcattcaatgatcctaaagtttttctgaatgaaatagacagcatcgactgcaatctgtgtattctggatattgaaatgcccggaatgacaggtcttcaggtagctgagattatttcaggctcaaaaaaaatcatctttacaaccgcctataaagaatatgcggcagaagctttcgacctgaatgtggtggattacgtaagaaaacctattaaaaaagagcggttgatccaggcatttgagaaagcaaaggaacttgtggaagacagtcctaaaaagccatttatcgaatggaataccaacatcggaaaaaccgttatattcacagaacagatttcttatataaaaacctccgaaattgacagcagggataaagatattatactcagcgacggaactaccatcgttttaaaaaaccttaatttcaaaaatcttctggaaatgctgccgtccaaagattttgcacaggtcaataaaaaagaaatcattgccctgtcttctattaaagtattttcaaccaacgaaattattacaaccattccttcggaagaccatacttttctgaaactccagatcggagatgcctacaaaaattctctgatggagcgatttgggaaataatctttcttcagatattttctgtttcattacagaatatacccgctttattacagcgcatcttttcaatatacaatccattttacttttgcagagaattaaatgattttataatgaaaaactttttctatgctgcaggaattctcatatccggtttctgtttttcccagaaaacttcttcaaaagttaaggcttcattttttgacggaatagcaacagccggatatgtagatcatggtgcgtttatcaactttacaggtccgaatctgaacgttacttacaaaaatgccaaatttatactgggaatgcttccttcgctaaggattaaagaagacagatcctcaggaaccaaaaacagtcccattatgcctactctgggagctggtctgacaatggtttataaaaagattgccgttcagattcctgcttactataattcaaaaacggccgatcagaatggcagctggaaaataggaattggacttggttactctttcagatagattttattacattttttagaacattcattacatttaaaaaaaaagagtatttaacataactatattcttatgaactttgcatcaaaattcgaatcatgaatttggggaaatacaaaaatttaattttctacattacaaccatcgcagtcttttccggactgatgtattacttcattatcgaaggacaaacgctggaggtaaaagaaaatatcgttgccagcaccagcagtggctctacctgggaaaatttcctggaatcatttaaaaccaatcttcaccatccgcttgccttattgctggcacaaattgtcacgattattatgacggcaagacttttcggatggatttgtatgaaaataaagcagcctacggtaatcggagaaatgattgcagggatagtactgggaccgtcgcttgtcggaatgtactttcctgaattttcagcatttcttttccctaaagagtctttaggcaacctgcagtttctgagccagataggtcttatccttttcatgtacattgtaggaatggagctggatctgagcgtattaagaaaaaaagctcatgatgccgtggtcatcagccatgccagtatcattatcccatttgcactgggaataggactttcttattttgtgtaccaggaatttgccccggacggtattcaatttacttcttttgctttattcatagccatttctatgagtattactgcatttcctgttctggcaaggattgtacaggaaagaaaccttcagaaaaccaaactgggaaccattgtgattacctgtgctgccgcagatgacattacggcatggtgtattcttgctgccgtaattgcaattgtaaaagcaggctctttcaccagctctatttatgtgattatcatggccattgcctatgtatttctgatgattaaaattgtaaggcctttcctgaaaagggttggagaccttcaggtaggaaaaaatacaatcagcaaacccatggtggcaattttcttcctgacgctgatcttatccgcatatgctactgaagtaatcggtattcacgctttattcggtgcttttatggcgggagctattatgccggaaaatgcaaagttccgaaccctttttatcgataaagtagaagatgtggccttagtacttctgctgccgctattctttgtatttacgggacttcgtacacaaatcggccttcttaatgacagccatctgtggatgactgcagggtttattattctgactgctgttctaggaaaatttgcaggaagtgcccttacagcaaagtttgtaggcataagctggaaagaaagcttaacgatcggagccctcatgaatacaagaggtcttatggagcttattgtccttaacattgggtatgatcttggtgttttaagtcctgaaatatttgcaatgctcgtgatcatggccctttttacaactttcatgacgggaccagctctagacttcattaatttcatttttaaatctaaaaaaaatcaggacgagcctattcaggataatgattccaagtaccgtgtccttctctcatttgacaagccggaatcaggaagtacccttttaaagctggcccacaactttacccataaaatgaatggcaataaaagcattacagccatgaacattgcaccggtagatgagatgcatgcctatgatagtaacgaatatgaaaattcacagtttcagaatgtaattgaaacctctcaggatcttaatctggaagttactaccctattcaaagcctctactgatattgaaagtgatcttaccagcattaccaataaagggcactatgatctgcttctgatcatgcttggcaaatctatgtatgaaggcagtttattaggaagattattaggctttacaaccaagattattaatcctgaaaaactgctgaacacagtaaaaggtaaaggtaatatattcaacaattctccttttgacgattttacccttcagattctcgacaaaaccaatattcctgtgggagttctggtggaaaaggattttaacgcagcagataaagtatttgttccgatttttaatctgagtgatttctaccttcttgaatatgctaaaaggctgatcaataacaataattcccagattatcattctggatgctgcaggacagatcagaaataatattgaggtaaaagaacttatcagaagtattgaacaggtggctcccaatcatattacgctgtataacgaaaaaaaaattgagaaagaattcctgaagtctcaggacctgatgctgatcagcagtaaaagctggaaaaacctgatcgataccaaaagtctttggctttctgatatcccgtccacattaataatttcaaacccttagaccaaaataacacaccgatatttctatttctaccggaagctgtaaatattattcgttgtctgtaaagaaaaaacgggtatatttatagcttcaattttttggacatgctgattaacagtgaaaatggagttataaagctgaaaacctttagtaccggactttataaaggaatgagtcttgatcagctgaaacagtctgatttttatagagaaaagtatgatgatgtgtgggatgtcaaaaccggatatttctggtattattttaagcctatagaaatacagggatatcagatatctttcagtctgtgcttttttgaaaatcagctggacattgttcacatgaacacatgggaaaatggtgatgccaaagattggagcgaatggacggaggaaaaagaaatgaatgtctttcacaggaacaacacttttcttacaaaggttctgaatagatctccaacccaaaaaaagaaaaaaccttacccaagctgcaccttcaagttttcctggggaaatgtttggtcggtgtacgacccaagaagcgccgccagcctgatgggaatctattataatgaagaggaaaaacaaataaaataacttataaccaaagattaagattgtaatatgtgccgatatgccatgatggtttacaaaggtcattatgcctgtttcaactgccggaaaacattcaaacgccgccaccttaaagatgtggaccgggatgctcaggtttcagtggaagccaaatgtcccgaatgcggaaatctgatggcgaatatgggactcgacttcaaatcaccacctaaaaatgatgataagcaatgggcccatatccaggatttgtataccgtcggaattacttttcattcgtgtggatgctccggccccggttatataccgcaggaccggaaagcaattattgaatatctggaaaagatccgatcagaatatatgaaatcactggtattctggagatatcgtattgaacctgaaacaaaaaaagaaagggaactggattatcagaagaacagctcacatctatgggccgtcaaccgtaatgctttcaaagaaacggtgaccaatcaggaaggaatcaactattggcttaaaagaatcaatgaagttgaggaaagactgaatattattaaagctgatcaaaagaaataactagtattactctgttattttcagaagtttataaattcgctgaaaaacaaagccactgttcattcaacttcccgatattccatatttagatttcttcagaatgacaccattggaatgtttgtcatatccatacaatttgtcattccgcacgaatccatcctgaattacattaaaaatacattagaagctcataattctgacaaaaaccttaacggaagtgtaacattccctaccattggaggagcgtcaaaaattctttgaatttttgacggggtggttatctatatggtatcaatctcatgtcgtaattctacgacaatttttaaaatttaaccccaaaaattaatttcaaatacagttttttaatagctttataggataattcactttggatggaaattgatttcttacaatatcaggtacggaatggagacacgctgacttctatcgcttcccggctgggcatgaccggtgaagaactgaagctgtttcataatgatcattgcgaaaaaatggacaggatctggtttgaaaaccttaataaagtgaaaacgatttttgttcctgtacattacaaaacagaagtacagaaagagcaggaaagaaaaagtactcttccgtcacaactctctccttccttttttgccacaacatacactgttaacgaaagttttgaaagcccttttgaagatccggttaacatcggttacaccattgatcttcatctccgtaaagaccaaaacaaagaacaatatattgcaagctacatccagaaagattttacatctgatggaaacaagcctgatgataaagtaagcagtctttccattgcctgcatgaaaagtattatgccccttgagtttattattaataaacatggcaaaatcacggggcttgcagatcataaaaaaatcactgacacttttatccatcagcgtaaagatcttgaagagttctatataggagaagtttctcaaaattacatgaatgcttttgaaaaaaatattaaagacgaatcatttttattactgcagcttcagagtacgcttctgtttcagacgctgtttccaaagacagactggtttcagaagaaaacaaagtggaaagaaccgttttattttttacagaattcttttccggtacaatgtgaaatcaatatagaacaggaaaatggaggtgaaaacactgttttaacgattttgaatggcaaaatcagtgaattatgtacatcacaggagatcctgcgtggaatcaggcttaatgaaaagacatcagaacctgcatcaggtaatattatattagaatacaccacccacaaaaaaaataaaaatcttcttcaggcgaaagcttcggtttcattgagccatgaaggattatcaatacaccaacaccatatcaacataacacaaggataatatgaaaaattatgtcatacaaaaaggcgatacgttcagttcgctcgcccggcagtttaaggtgaaagatgaaggaattttaaaaacgtaccacaaccttcactgtccgccggaagatgttatgcaggaacctgttcccggaaaaaagattttaattccggaagacccacaacttatggctgaagaaacagaacctcataatccctcttcatcctctggagaagaatctacagaagataccggtaccggggaagaaaacccgacaggagatcagcctcagaataaagaacaaacgtcagaaaaagctgatcaatcgaataaagaagaaaaaaaggaagataatagtgaagacaatagttctacccctcatgaaggaaaatatttcgttgtgcagaaaggaacggtacaatgtaatcagggattcaaatttccaaaatttaaggtaacaagccatcagaagcattactggaacgatgaagaaggaaacgctgattatctggctgtcacagaagatgatttacagctcgatcctgcagcacaaccattcggacaatgtaagcttaaaccgacttcaggaggctatcttccctgcgcttacgctcctgccggaaaatggcagaaaacctatgaaaaggtaaaagtgatgggaaaaagctgtcttacggaaatttcagaactgatgtgcagcacgggagggaaaataaccattctcaagcacggacagcaaagtgaagcaggcaaaagcaatgttgccaaagcaaatacgcaggaacagcaggtttataatcctgttgtagattttgatgaattcaaggaagatacaaaaggaacagacgaactttattacagctaagccatgacaggaactattatcggaaatcagaatcctttggcaggaacaacatattcctacgaagtaaaaccttccctcctctcattcggactgaaaggtgaatatgaatggtatctttacaagaaacagaaaaacggaacctggaaagacatcaccggaaagcctaaaaccggtgaaaaggtaacttaccgatttggagaaatagccgtaggaatagagtttcaaatgaaagtctatgagattaaaaaagctattttaccaggacttcctgccagcaaggaactggctggcacccttatcttgattccaacaagcaataaagtgtcaaaaatagataaagtagttcttttcaaccggggagcagctaacgtcaataaagccagttatcgtgatactcttattgcgcaggcacattgtactggcatgtttaataaagagatcgaattccatctctgggaagatgatgcgccgggaaaaggccatgatcctgtcattaataaaaacaaccgtcatacccgcagctacaaagctctggtgaatgcaaagggtattgcagaagtacaaatccccctgatgtctgatgaaaaaatccttcgccagatggccaatcagtttatgatgaaaggtgacaaaaatgaaggagccaatcatgagtattatgttacggcaagctattcaggtcaaattcaaggagcaagtcaggtgaacgtagatgtagctaatccggattataaagggcaaccacaaaatcaaccgaagccacagcctaaacctcagccccagaaaaatacaccaaagttccctgccggatccggaaacgctcccaaacagtctgatcctaaaggcaatattatagaagctgttttcattgatgataaaggaaatgaactttccaaagttgctgtaggggataaagtaagggtcaggattcattccaaaaatatggtgggaaaacacattcagtatgtaatttgggaatatgataccacgtccaatgatgaagtttacagaagcggaaacattaaaattcctgccgatgtatgtgatacttcagggtttgtcattacaaaagatatttttgaaaaaggaatagactcccctatcggcgatccagactcggataaacaaaactattttatcgaaattatttccaaggatctttctgcggaatctcagaaatttggggtaaatccggagggtctgatgcaggtggagaagttgaagagtgcggcggcggtgcagaagcagaaacaaaaccaaaaaggagaaaaatgtttttgtaatagagattttgaagaaaaggatgtgagacagcttgttaaattattaaaaggcactgaaacaatttgggagggacaagcattaaaagggggaagaagagctccatgtaatatcagtgacaagtcttttgcaacccttacaaaagcattaaactctgcattcaaaaagtataatatcaatacctgtattcaaaagattcatttcctcgcccaagcttgtgaagagaccggtacctttgccctatctgaagaaacaaaaagtgattttttatcaagtcagagtatttataaaggccgcggattactacaactgacaggtgtaagaactgatgagaaagatttaactactttatttaataaaccaggaccttacaaagattatgctgattataaaaatgatcaaaatatcgtgaaaaatccgagcattgttgctaataatgtagattattgtattgatagtggagcttggatttggagcgttaataaaaagatgcccaaagctccttctcctgctgtagatcgttggggcatagaaacatcagaaaaatcacttaatcaattagctttatttggtgacaaatatttggaattgatatctgttcttttaaatggaagaaatgaaaagacaaaaatgcctaacggatgggaaaaaagaaagaccaactataatatcttgaaaactggtttttttatgtatgacaggtttcacaatgataatagcaaacctgccaacgcaaaggatattgttacttatcatatttatgctgacggaacaattgaacgccatattcctaaaaaaattaaatctggatatgaaaaaaagtacaagtatgtatatcatgataaagataaaaaagagcatgaaatctgtatagttgactggattgaaatagataaagttgaacgtcaaaaacctaatcctacatctgttccaaaaggatatatctctcacaattcctttaatatttctggggtcaaccaaaaagatgtttacaaatatagtgatggttccatcgttgcctctggtaaagcaggagaaggaagtggaactattttaagaaaatatgttaaatcaggaggaaaaacaattattgtaaaaataccagatccgttgaattataattctggtaattctaaaattaatcttgtctttaaagatacaattagaaagtatatgggacgagatcattttgcctgtttgattggagcattagctgaaacaggcttttctaaagtaacatcaggaggagccgcgatgcaagatggaacttgttttccaagtgtctcgcatacaaatggtagtagtatagatgtagcatattttacacatgcaaatacacaaaaatttattaattcaatgattaaatttggatttaattattttttagcagggacaggaatgaatttttcaaaacctaaaggcttcaatggaactcttgaaggaggtcattctgatcataatggccatttacacgcaggtgcccctaaatcattaagtataagtataaaagaaataaaagaataaactttaaaatgagaaacgtagtatttttattaatatgtataatcttaggaaatatttcatgcaaaaaaaatagttttgagcataattttgaaaaacactccaaagatactattgaatcacaatatgaaacaccatactttgatgatgacaatattaaagacaaagcacaaattaaagcgaaacagagtaatgaactttcaagttttgtactgtcgatttatttatcctctttgaataaaacagttgaaattcccatattaaacaatagtgttctatataacaatactgaagctgattattatttaagtgatccaattattaataacaagatcatcaccattcgagtagattatgccgatcaaattacaaaaccaaatatttcaggagaaagaaagaatatgattgaaaaaataaaatttaggtttgatactaaaaacaaaaaaatacaagttataggatatgatttaagttatacaaaagctaaaaataattattcaaaatcatttaattttattactggcaagttttattctacatcatcttttaatggcaaaaaggaagaaacatctggttgggcttcagaacttcagaacatatacatagaaaatttgaacagtgattttttcaataaacttttattacatggaaatgagattgaataaattcttaattaaaaaatacaatatatcaccacgtggttgcaaaactgcactataaatatttgcaagcaccgattaattatatcaaaaaaattccgtttcattaaaaaaatatttatacctttgctctgtgatttttaacaacggaacatattattatagaatttttacctcagctctgggatagggattcttatgaatataatttaaaacctcgtcctagggacgaggtttttttattttaaaaaatgtaaaaagatgaaaataagtattattggagtgggattaatcggaggttcgatggctttgaaattaagagagaaaaacctggctagcttcatttacggaatcgataacaatacacagcatatcagtgacgcattaaatcttaaaatcattgatgcggaagcaggtctcgaagaaggaattaaaaattctgatctgattattcttgctattcctgtagatgctgcgaggaaattactgcctgcaattttagatctggtctccgatcatcaaatagtaatggatgcaggttctacaaaagcaggcattgtacatgcggtaaaagaccatccgaaacgttcaagatttgtagcgtttcacccgatgtggggaacagaaaacaacggccctaaatccgctattgcagaaagtttctccggaaaagcgggtgtaatatgcaacaaagaagaatctgcagaagatgctttggctaccgttgaaaaagtagtcaatgcccttgatatgcacatgatttatatgaatgcagaagatcatgatgttcataccgcttatatttcccatatctctcacattacgtcttacgctcttgccaataccgtccttgaaaaagaacgtgaggaagaaacgattttccagcttgccagctccggtttttcaagtaccgtacgtcttgccaaatcacatccggaaatgtgggttcctatttttaaacaaaacaaagaaaatgtactggatgttctgaacgaacatatttcccagctcagaaaattcaaatctgcccttgaaaaagaaaactatgaataccttgaagagctgatcaccaatgccaacagaattagaggaattttaagatagttattatctaagatactaaaagcctcaacagcttttacttttattttattaagaaacccttagtcagtaatgcctaagggttttatattgtaaaacactgatatttctattaacactccggaacgttaactgcaatggcaagtccgccttccgaagtttctttaaaacggtcactcatagactgagcggtttcccacatggtcaaaatcacctcatccaatgttacttttgccttggtaggatcactttccaatgcgatattagctgcggtaatcgctttcatagcgcccatagtatttctttcaatacatgggatctgcaccagtcctttgattggatcgcaggttaatccaagatgatgttccatcgcaatttctgccgccatcaaaacctgccctacgcttccccccagaatctctgtaagtccggccgctgccattgcagaggaaaccccgatttccgcctggcaacctcccatcgctgcagaaatagtagcgtttttcttgaataatgtcccgatttctccagccacaagcagaaatcttactatatcgtcatcagaggtaaacggagtaaatgcctgggcatacatcaatactgccggaataactccacttgcgccattggtaggtgctgtgataattcttccgaaacttgcattctcctcatttactgccagggcaaagcaggcaatccatttgttgatattcgtgaagttctcttcagcatctaccacctgctggaaccattcatctttatttttatagattttatctcccagaagctttctgttgattcctgcagctcttcgggaaacattcaatccacccggaagaacaccttctttattcacccctttataaatacattctttaatctgctgccagatataaagtgcttccttcctcgtttcttcctgtgttctccaactttcttcgttgatcagaatcaaatcagacattttattaagcccaagtttttcacagtatttcgcgatatcagaagctttatgacaagggtataatgtacgtacacactgcttttgaatagaattcttttcctggctggctatgaaaccgcctcctacagaataaaaatcctgcacaagctccgttccatcctcaaaaacagctctgaagatcattccgttaggatgaaaatcaaggctttttttcatgtttaaaaccaaatggtgcccgtagataaatggaatgactttctctcctcccagattaatagtttgagtgcttttaatatagtctatcttctcatcaatttttgaagtattgatcgttttaaaatcctctccatttaagccaagcattcccgcaatatcagttccgtgcccaatccccgtttttgcgagtgagccaaaaaattcaagaaaaacctcttttacttcttcgattgatctttctctttttataatcctgataaatgcagcagcggcattccagggtcccattgtgtgcgaactggacgggccaattcctactttaataatttcaaaaaccgatattgattccataaatgattcgtcattttcctcaaaaacaaagatacatgataaatcccaaaatcaaccttcaaatctttaatgaaaatcaagtatgatcagaatataaaagctattgcaggcattcctcatgctgggaaagatcaaggcctttattttcggactcttcggaaacccttagagtgatcatagagttcgtaattttatacaaaagcagcgaaccaaagaaagtaaaaacagagacaagaaccagggcagccatatgatgaagaaagacctcaattccgccatgaagcagacttgcattttcaccatgggcaaaaacagccgtaagaatcatccccataatacctcctaccccatgacatgcaaagacatccagcgtatcatctactttctttaaagccttccagttgaccattatattagaaactattgctgtgataaatccgataaaaagactttcctgaatacttacaaaaccacatccgggagtaatcgccacgagccctactacagctccgatacaggctcccaaagcagaaacacttcttccattgattctgtcgaaaaaaatccatgtcatcattgcggaagcagaggcaatagtcgttgtaccaaaagctgttgcggcagaagcagaagcacttaatgctgaacccgcattaaatccgaaccatccgaaccataacattccggtacccagcagtacataaggtatattggaaggctcatggtgaggattttttctgtttcccactaccatagcacctgcaagggctgcaaagcctgcgctcatatgcactactgttccgccggcaaaatctttcaccccgaaatatttatttaaaagaccatcaggatgccataccatatgacaaagcggtgtataaatgaaaatactgaaaagaacgataaataataaataggaaataaaacgaaccctctctgcaaaagatccggtgatgatggcaggagtaatgactgcaaatttcatctgaaacagggcaaagagaataaaaggaatagttggagccattattttatgcggcagattacctactccacagaaaaaaggatagcttaacggatttccgataataccgtaatgctttccgccaatggtaattcccaatgaatttccaaaagataaggaaaagcctacgactacccataccaaagaaataacgcccaaagcaataaagctctgcagcatggtagaaatcacgtttttcctgccaaccattcctccgtaaaagaaggacaatcccggtgtcatcagcagaacaagacctgccgccgccagaatccaggcaacatccgctcctacaattttatcttcacttaaaaactctcctgtatgaggaatatcggcaaccggattccagaataagcctccgattgcaaccagtgtgatgatagaaaatgaaacaatccattttaaccctactttcataaaatttatatttaaccctatcaaatttaaacataaatttgataaaaatgatatttttaatcaaacacccctataaaaaaaatactatttactagataatactctaattttcacaaaacacttccttcaatattttggaaacttctttagatttggtagcagggaaaagatgggttcctcccttcactacataatcaggtttggagtaacggataggaaaaacgatatctttatcacctaatatctgaatgacattgggattttcttcaaacttccattcagccactttttctacagaccacttcaggtaataaggatctcttactttaaaatattgcagaagtcttggatttttagggtcaaaaagctttctgataacagcatatacattggcggccctgtcattgaataagcctacaggtaatattctcgggattttggtaacctctcccgtctttataaatctggatttttctttatcggatttaatgcttccaaggattactaccttctccgcaggtttcaatttgttaatttcctgcacaataattcctccaaaagaataccccagaaggtagaatggttctgaatcatctattttctctgccattcttttaacgtaagcatcgaagggctcatttttttcggggatgagccaatctataaaaatcagttcacagtgtttgggaaattctattctttcaaggaccttgaagtctgctcccagaccgcttacaatataaattttcataccactaatttataaaaaatacagaaataaagaatgtcctcttgctttaacagcactaaaaaagagcagctcctgggaactgctcttctgtatcaataaaatatattttactttttcttttttggaactctgttctcgttatccagcatttctgtggaaactttgaactgaatatccatttcgttcttgatgaagtaatctttcagtgaagactgatagaatactttaaagtctcttctgttcagagagaacttggcagattcaatagatgtggtaaactgagtaacgtacacattcgcagggaaagagattgtttttctcactcctttaagggtaagatcaccgtatactgtagaattgtattcactgtttgctaaaggaataatctttgtcagatggaattttgcaatagggaattttttcacttcaaagaagttggagcttttcagatcattagtaagcttgatctggtcttcatctgaaacatctcccgccatcaggcttctcatatctattataaattctccgtctacaagaaccgtatggtcaaagttgaattttccgctttttaactttactgttcctgagtgggaggtttcctgggttttcaccaccttatacccccaccatctgatctctgatgaagtcacttttgaaaccttatcaaatttcttttgggcagaaacaaatgatatgcttgcgcacaccatagcaaacaatagtaatcttttcattcttttttatttacaattcaacaaaaataaaaaaaagtgtagaacttctacacttttaacaatctttttttgattaatttattgagcagttacctttacaaccatatcaatatcatctttcacaaaaacatcctgcattgtagacttgtaagcaacatcaaatttctgtctgtcgaaagagaatttgttggataccaaacttactacccctttgctgtaagaaattttagcagggaaagaaatagggtttgtttttccttttacagtaaggtttcctgttacaagagaattgtaaattttgtcattgtttttctttactcctgtaattttaaaagttgctgtagggaatttttcaacttcaaagaagtcaccattcttaaggtgcccgtttaatttttgctgatattctcccgtaaggtcagtagaactgatagaagtcatatccaatacgaagcttccgcctaccagttggtttcctttcattaccatatctccggactttacttttacagtaccgtcatgagagcttgcttcagattttgctactttgtatccccaccagtgtacatcagacgctactactttttttgactgtccgaaagctagaccaccagctaaaactgctaataaaaatatttttttcattgaatagagttatttacttatttaacggtacaaatgtaggtatcttcttcaatagatttcattgatgtatatcaataaattttattattttcatgaataatatcatcccataaaaaaactccgaatttcttcggagcctttatttatacctgatagtacgctgtataaagtgctataccatttagtgctgtatgattttgcttgaccagataaataggaatatttttaagcatttcttccattttatcactgatcttgaatttttcatagaactttcctttgtctatatactctcttacggtctgtgcaatatcaccggcaatcagtaatcctccggtagctttcagctttaatgtaaggttgttggcttctcttgccaggaattcaaggaaagtatccaaagctattttgcagatgagtacgttttcttccacagctgctttataaagctcttctacaaagttgccctgtgcaaggcgctctcccaaccattccggctcaggatgtcttttcacatctcttaagaatctgtaaatattgaataatcctgattttgaaagtacattttcccagcttacaataccataaatattattgagaaactggtaaaactcgacttctacgttggttcttggtgaaaactctgagtgtccgccttctgttgcgaaaggtctcaggtattttccgtcaaagaaatatccggcctcacccaatccgtttccgggagcaagaacggctacatttcctttttcaaggtgtccgctggtatagatggcttcaagatcattatcttccagcagagacattccataagcagatgcttcaaggtcattcagcatgtctactttttcaaacccaaaatcgcgggcatattcagcaacatctaaatgccatcccaatcttgcagggctgcttttcccgtccagtacaggacctggtacggccattcccagacgttttacattttgcaattgattatcctggataaacttcttcagaatatctgaaaaagaagaatattcctgggttgcatatgtattttctaattttatctcaagacctccgttcccggaaacgaaatagcctaagattgttatatcttcacggaggcttgctccaatgatagaaacattatcattattactgttctctactcctggtaaataaagtggaaattttggattcagaatcataacctcaaattttaccaaatataataattgtttttgtaaatcctgcacagaacaaaaaaacctttccactttcgtgaaaaggttttggttaataattgtttatatattaaatctaactactttcctaatggaatattgtaaccgaatcctactccgatattccccacattataatcctgacctggcaaatctcctttagttcctacaaaaaccttttggtattgtacaaagaagttccagtctctgttgtggtatccgatctccggtttaaggtaaaaacctccgtctgctctttcaacattggtatttgatgctacggctttatccccaacaaggaaaccatatcctaagtctgttccgaaatagaaaccggtttgttttggataaattctgattaaagcagctacaggaactactcccacatcattatttttatatccgttattgtcttttccaaaatagtgagtatatcctgatgcgatacctaacccaaatcctggtgtaatcaggttctggtaagatacatccactcctactgcagcggaaagattatctgcgggaactgctaaaccaacattcgcacctactttgatcatattgttcatttgagcactttgggcgcttgcgatacctgctgttaaaataccagccagtactattgcttgtttaaacattttcataactctaatttttaaattttactaaacaagaggatgtaaaaatcgtgccaagcaaggctttttctttgattttaacagtcaaacacaacataaatcaatgaatatcaatatcttaattttaacaaaatttaaatgtttgtttaacaaaaattatcaaaaaaaggatcccgaaaagtgaattaaagaaaaaagaaatgaagcaagaagatggaagctggaagttatatcctcttatatgaaaaactcacatctaattaaagtaaagagaaatttctccttcctttacaacataactccctgcttcatgcttccagcccgcataacaatattaacaatccttaacccgttactattttaacctttttctatgaaatacatcaaaaaaataaattctccatgatggctgattcattaataaaaaacaaacatcttctctggcgtgcgggttttggtgtgggtattaatcaaattgatgatttgaaaaataaaaacgttaagacgataatcaacgaattatttaaagaagacagttttagtgagattacctatgatactcctgaccctgatttagccgcagactacatgaacagcacagctcctgctgaaatgaaaaaagaaatgcagcgtattaacagggaacaaaacaatgaactgaatctgaattttttgaataccatcgtcaacagcaaagagcagatgagggaaaagatggcatttttctggcatggacatttcgcctcaagggtaatcaatccgaagttcaacagacagcttttgaatacgatcaggaagaatgcactgggaaatttcaaagatctgctttttgaggtaagccagtcaccggccatgcttaattttcttaacaaccagcagaataaaaaagatcatcccaatgagaatttcgcccgcgaggtcatggagctttttaccatgggaagaggcaattataccgaacatgatgtaagagaaggtgcaagagcattcacaggatggagttatgataaggaaggtaatttcaaagaaagaaaaaatcttcatgatgaaggcagcaaaacttttctgggaaaaacaggtaactttgatggaaatgacattcttaatattattctggaacagaaggctactgcacagtttattaccacaaagatttataaattctttgttaacgaaaaaccagatcaggatattgtaaacaaactcagtacgaatttctacaattcagggtatgatattaaaaaactgatgactgagatattttccagcacatggttttatgatcagaagaatatcggcaaccggataaaatctccaatagaactgatggctggtatgatgaggatccttcctatgcatattcagaatcctgaaaaccttatcgtgtatcagaaattactgggccagatgcttctttatccacccaatgttgcagggtggcccaatggaaaatcctggatcgacagttccacgcttatgctgagactccagattccacagatctggtccggactccgccctttagaatacagcccccgccaggatgatgatatcgatatgggaatgaaatcccgtgaaacagctttgaacaaaagctttaaaaatcccaacattaccatcgattgggataggattgagaaagtttttgctgataaaaactgtgaagattatcttttgcagaatactcagagccttgatatgaactccgtaaagaatttttctgataagagtatcaaaatgaatgtcatcaacctgatgtctactccggaataccagctaatgtagggagaaggttttaggttgcaggtagcaggtagcaagtaaagctgtcgcagtataacttgcctttttactgctataaaaataaaatgcagcccaattcctaacttttacgtgcaaactatcatctgccaccttaaaaccctaaaacaaaattatgttaatcaaaagaagagaatttctcaaaataagctcactggctacggcttctatgctgatgcctaatttcttaaaagcgatgacgttggatgaagctttgaatcccagtcagaatattctggtcgttcttcagtttacaggtggaaatgacgggctgaatactattattccagttaaaaatgatatttatttcagggaaaggaaaacactggctatacaggattcgatacctttaacggatgaggcaggaatcaatccgtctctctcctattttaaagagctttttgataatggtgagctttctgtgatgaataatgtaggatatcccaatccggacaaatctcatttccgaagcatggatatctggcagtcggcaagcagaagcgaccagtttctggaaacgggctggctgggacgtttcctggacgaagaatgctaccgctgcgaccatcctacccaggcacttgaggtggatgatatgctaagccttgccctgaaagggcaaaataacaaagccttcgcatttaaagatcctaaaagactttaccagacgagtcaggaaaaatatttcaaatccctttatgaccaccatcacgatgatgaaactgtatcctatctttatcagactttaggttccaccatcaataatgccgattacatctttgaaaaaagcaaagctaaaaagacagagcagatttatccgaactctcaattgggaaaagactttaagactgtagcctctttaataaagtcagatatcaatactcaggtttactacctttcggtaggaagttttgatacccatgtgaatcagaatgaccgacagaaaaaattgttcaatgatatcaatgaagcagtaaaatcttttgttgccgatatgaaaagcaatggtctcttcaaaaatattttactgatgacattttctgaattcgggcgccgtgtcgctcagaatgccagcaacggaactgatcacggaaccgctaaccagatgttctttatcggtggaagccttaagaagaaggggctgttaaacgctctccccgatctgcagaatctgaatgaaggcgatctgatctacaaagaagatttcaggaaagtctatgccacgatcctgaaaaactggctaaaggcagactcttctaaagtattgggatggaaagacgggatttatgattttgtgtagacggaccgcaaaagtcacaaataaacaatttagatttctacggaatgacaaactgtgagaatagaccatcattataattgtatcattccgtaggaatccagtcacaatcttgcaaaaaattataattctgaccaatatatcaattgaaaagtaagaattccctccagcgaaaagggtggcaaaaatttaaagaatttttgacggggtgatttttcagcattctaaaatatccatcaacaataaaaaagagactgtacctggttatgacagtctcttttcaataattttaaattttaactactttacgtttaagccgtaatctgctttggttctttttctttctgatcttcttttttatcaagtttctcagatattttttttacaatatattctattgctatgggtgctatgattgcaattaatgctttaaaaattcttgatttcatacatataattttgtgattacaaataatgcaatttccaagccaagatgaaataaagaaacaaatactcctttgcagcctcctattaatgatagatttaaatcaatcagctttcttcagggatgatcaggttctgataatttttatatccggcattgaacttttcctccattttcagccgtaatttctttggcttatgaacaatcagagaatctccgaatcctaataacagtctttccagctcaaaattgatctgaacacagattttaaaaagtgtaccctcatagtcttctctgataatttcctggcttttatgcagcggcttggttttcacatacggtgcatttcccgcatctacccagaagatcacatttctcggatccattgattctgatacggtaacgcctacaatatctttgaaatattcatccccatccaggtctttatcaatatactgaacactgtcatccacttcaatactttccattctgtccagtgccagattgtacattttctgtttgtaaagacagatcaggaaccaacgattgttaaattccttcagcagctgcggatgtacagtatatatattggattctcttgccgtaaagcttttgtaaagaatcttcaaaactttcttattagcaatactttcgtacagaatatcaatatgttccaaaccttttagctgttcatttttatccagatgaataatcgatttctggctggtggcatgaatagagtcttccagcttctgaatgaccccgttcatctctttgaacatggaaaagtccttgaactgtttcagaatctgaactgcattattcatcgctttcaggtcactttcattcaccgaaatattatgaatactgtattcagggtcgctgtaacggtagtattttctttcgtaaacctcaataggagcctcgtatccgaatttttcactccgcatattctgaagatccagctgaactgtacgtttacttacataagattcttttccttcaaattcaaacaatgcttccgaacattcatcaatgagatcctccagcgtatatttcctgtatttgtttttaagacatttatctaatgttttatacctgatcagagcatttttattcgatgacataccttagtgtttaatgattgggtgtttcagataagcaattcgcttattcttttttgctcttttccggctgttatttttcttttaaagcattaccgtcaaaggtaatcccatcccagccgaattttataaaattccggatattctgatgatcagtgccttcaggatttttcagaacatcatctctgtaaaactcaccaaaaagccaaagggtttcttcttttgtaagatcctgcatactggcaaagctgaacactttacacgaaccattattctgcccggcctggttggtggtatctccgttttgaaaagcagtaggggtaaactcataatgttcgtcaatataagcgataacatcattaaactgaatagtttcagggaaatgttttaattgttctaatagtaccatagatctcggttttattattttatatttatttcaacagatttccaccctggatgatctgctttttttaattttttgtaaaaataattaaaatttctttatctgcgcaaaactattgcgcaataagggtattactttgcatcatcaaaatgaaacaacaatggaatttaatggaaatcatttaatcgaattaggatatagacctgcaaaatggtttaaagatgccattagctatatcaatgagaataaactggatgaacagcagatcagagaatatctggtacagttcacacagccggaccttattccgcttcatgagacagccaaagattttatgatcaacatccgggctgagcatgaaagtgagaatgataatgtagataaagtaatcaaaaccatgaatgttctgatgaaaacccctactctgattggcggagctttaatgccggatgcctgccctactggccctgaaggtcagattccggtaggtggcgtggtaattgcccaaaatgccattcacccgggattccatagcgctgatatctgctgttctgtgatgctgacagattttggaaaagccaatccaaaagatgttctggatgctgcacattctgtaacacacttcgggtatggaggaagaccaagaggagagcagatgccgatgtctcaggaactgatggatgctttcagagaaaatgaattcttaaatgatgaaaagctgatcagcattgcccgttctcatatgggaacccagggagacggaaaccacttcctttttgtcggaatttccaaaaatacgggaaataccatgatggtaacccatcacggatcaagagctcctggagctgccttatatgataaaggaatgaaggttgccaatcgtttcagacaggaaatttctcctgaaacattaagagaaaatgcatggattccttatgatacggaagaaggtaaatcctattggaaagcgcttcaactgatcagacagtggaccaaagaaaaccatacttctatccatgatgccgtcctgaacaagcttgaaatggaaaaggaaaacagatactggaacgaacataatttcgttttcaaggatggagacctgttctaccatgccaaaggagcaactccgctggatgataagttcatgcctgatattacgggaccaagactgattccattgaatatggctgagccggtactgattgttcagggaacaaccaacgaaagaaacttaggttttgccccacatggagcaggaagaaacttcagcagaagccagcataaaaaatctctggctcataaaacgactgaggagatcttcaatgaggaaaccgccgggctggatatccgtttctattccaatgaaattgatatttctgaacttccaagcgcttataaaagtgctaagaatgtaagagcacagattgaagaatacggactttgtgaagtcctggatgaagtgatgccttacggatgtatcatggccggagatgtgcagaaaaatgcaccatggaagaaaaagaaaaaatacagaaaagcataatttttaatatgatattcaaaccttacgggctttagaaatccgtaaggttgaataaaagcaacaacttaatttcacagtaccagaaaagttaattaaagaaaaaattcaaggcaaagaaagttcctataagattaaaattactttccgcctttttaacccattataaggcaaagggagttcctatattttttggataaattactccccgctttttataaactataggtaaaaggagttcctatacccttcacttttaatgaatttactcctcacttattttttaaacttaaaaacaatgaaaacactacaattattcaatgctgtactggctaaagaatcgaatgcaaagccgtttatttccaatgacggttttatcattgaacctaatgctgtctgggcaaaaaataaaatcatatccttctataccaaggaaaaactgaacggaaatgatctgaataaaaccttccataaatcttggaaaaaaataaagaatacctcaagatatgatttattaattgaacagatcactcattatgtttcgacctatggaagcgattttcagaacgaaatttatattcctgctgaaatactgaatatcccggatatgaagatggtttttaaagtcatcaaagcgtacactgtggaagaaatgcaggaaaaatgtatttctcttttaagatcaggaatggctttaaaggaggaaaccattgatgatttgcttgatattctgcataacgaactggaatatgattttacagcaaaagaaaatatcagaaacaaggaagcgatcataaaaatagccgaccagtacgatatttatcctgaaaatcctgttgagttcttccgttacgttatttataaaacaactaacacaacgcttttaatcaaaaataatgatctgattaatcttattaagcagagtaatttcaatccaacctatttgtttgaaagtttcggactggagaaaatggcagaaatctttaaccggtttaaaccattattccttgcttataaaaacagggctccaaaagtcattaataaaatttcaaaactatctaaaacacatcataagccgctgatctcaaatccgttgaatgacgccaccaatacattgctggaaaacagcgactggcattggctggaaaacgcaacaccgttcgccttgttcaaagcattgtcagcatgccattcaagaatgtacggacaggatacctttgtctacagagtgagaaacggaaaatcatggactaaaaaaggtaaggaaacttacgtgaatcagttcaattatgattttattttagattttctgaaactgaagtatgaaaacctgtccggaaagaaattctatttccctgagcatgtagaatttgcactgccaacttctgaaaagatgtttgtgggaaatattcctaccggaacccgtttttatgctaaaagacttgctgtaggagtgtattgggaagatcgttggggtgcccgtgaccttgatctttcaggattgaatattgcaggaaaaataggctggaatgctgcttataatcacggaaacggacagctgatgtactccggagatatgacttctgcgccaaatggtgccgttgaatatctttatgccaataaaggacactgtgcaccaacgcttgttatgaacaacgttttcagtggaaatgcggattccggatataaaatcattatcggaaaaggggacaagatttcctacgactatatgatgaatcctaataatctgtttgctgaagccaaatgtaacgctgtccagaagcaaatgattctgggaatgctgctcacaaaaaacgaaaaacaatgtttcgtactattgaatttcggagcgggtcattctcatgtttcaggaaataatcaggtttctgtgatggcgacaacggcattgtaccaacaatggtatgaagccatgtccttcaatgagcttataaaagagcttggaggtgaaattaccacagaaaaggcggaagctgattttgatttctcgctggaaaacctggaaaaagatagctttatcagaatttttaaataattcttaacgctgcctgagtatatcaggtggcgttttttatgattcgctgggaaaacgttgacaaccaacccgttgacgattctttgaatttttgcgaccctgccaaaagaggggaattttcactccttcagctgggatattaatcaggattgtagttttccaattaatttttctagtagcatttgtccggattcctacggaatgacacaattggaatgatgtttatccatacagtttgtcattccgtaggaatccagcctccaaaattcagaattccctaatgtatactattacaaacagcttaaactttggctaaagccgtttgaaaactgtaatctttatcaaatggactaaagttagttgctattgaataaaactttaccttaattattcattcacctttttcactgaaagaattccttcatttacactaataatcactttcttcccatagtcaatctgaatattgaacatattttccagtggaaactgaagcacagcctgaagaattaaacgaataactccggcatgggtgataatcagaactttattgacatcatttttttgaatcagttcactccaaaagctgagaactctgttttgcatttgaatgagattatctccgccggcagctttaacattgacaaaatctttgtaccagggattgatttcttcttccggaatatcggtccattttttcagttcccagttgccgaaattcatttctctgagtctttcatcagtgtgataattaaatttaaaataatcagctaataaacagcagcgctcggagggactggaaataattgcatcaaaactatgatcaatatccaacgctttaaaatcatcaatataatttttccttaaaggcatttcagcaaaaccataacacaggttttcaggattttctacagcggtatgacggatcagatgaatttccatacgatgattgttcccaaataaaataaaacttcacaaacctgctgcacagacccaagacaatctcccgtgtagccaccaatatgctttttaaaataccagcccatatagattttaccagcataagcgagtgcaaaagcaaaaatcaatctccagtccgggatcaggacaaaagccatcagaacgcttataaatcccaccaataaggccattccatccaagggtttattggccagaggtttcgatttgctgacatcaatatctgtaacatattggtgagtgtagatcatcgttcctgaaataaaccggcttaccgtatgggccagaataatgattcccagcaatctgaccgtttgatcactgatactacccaacgcctgaatactgtaaaatttcaaggcaaaaagcaggataattccaatagttccatatgctcctactctgctgtctttcataatggtcaggattttttcttttccgtatccacctccgaagctgtcacacatatctgtaaaaccatcttcatgaaaagctcctgtcagcaaaacaccggcaatcatcattaaaacaatcccaacctccaggttaaacaacatggtagaaaggaaaagcaccgctgcattgatcaatccaaccaaaagtccaacccatgcgaaatatttctgagatttattcataatctcaccggaatacggaacagtaaacggaaccggaattctggtgaagaacatgagtgctgtagcaaaatagatcagttcatttttgaggattttcattttctttttagtctaaaaaaattgttaagtcaatttccgtaaaattaggaaagcttttaacaacagtaaagggatcagttaaaaaaataagaaacatgaatcttatcacgtaaagttatcttttttatttcctgagtatttttagttttgcaacgtaacaataaccatgaaaaaagaacaaatgaaaaaagcgtatttcgttggattatgtcttatatccgtcgtaagctgttcagctcccggtgatgagctggaaaatgtaaatgaagcacaggctttaaatgcatctggtagtaacatgtcagcaaaaggaggcttcagagatactccggacaccccaactcctccccctgcaggaatctggtcaaaatctttttatttaacgaatcctatttacggtttctacagtaatctgaccaaaaagcacctgtacaatacctctccgttaccatccgaacttcccaaatcctatccaggactggactattattttcaggaaagattattaggttctgcagacggacccggccctgtcatcacaagatggtttcacacaggaaccaatgatctggtattaacgactaatcctaatgaattggtgggacaaagtaattgggaaaaaagaaatctcggcaccagctataatggtgatgagccgggaagttttccgatttacaggtatttcaatggtgataaaaagacgcacttttataccagagacaaaaatgagctgggagacggaaaagacggttatgaatatgaaggaatcgctttctacctgaaagattctgagcccaaagcctaccgtgttcatgacggacagtttttccaggataatgcgacaggagccctttatatcgtatttgaaagtaccctgagacgtattgaatcttttgcagtgatcaataatctgtttgctgttcagggtaaagcctatctggtttttaaggtaaatatagaagattacacaggagaaagaggaccggacatcacttcaggaactcagctggtaagaaacaccaataccggaaagctgtatcttgtagatgatggtttatacaggtatatccctacgatgcagatatttaatatctataaattcaatgaggatgctatccaaaataaacctgtaagaatgatgtttacaggtaaagatgttgcacacacttattaattatatttgaatttaagataaaaaggggcttcattgcccctttcttattgtatgaagttaagatgatttattggaaatatgagcatcttcaaagctggacatttcattcaggaaattaacggcactttgaataatcggatacgccagtgcacagcctgttccttctcccagacgcagattcagattgagaatagcttgctctctcatcaatcccagcagctgaggatgggcattttcattgcttacatggcagaagatacaattgttcagaatctcagggttctttttccagaccgtggctaccgctaccgtggcgataaaaccatctaccatgatcagcatattatggtgatatgcttcttgtatggctccgatcatttgggcaatttccaatccgccaaaggtttgggcaatttcatcttcggtcatttcggaaggatatttttctaccgcttctgttaaaatatggattttattctgcagctgatggtcattcaatccggttccacgtcctacacaatggctgaccggaatatcaaagagcttgctcatcatcaaagaagaagcggaagtatttccaattcccatttctccgaaaccaataatattacacccttttttagcaatctcagacactacagatttcccatttttcagggcctgctgatattcttcaggagtcatagcgggttcttccagaatattacgactggatttccttacctttttatcaatcagattcagcccttcggggaaatcaaaattcactccggcatctacaattttaatgttgataccattctgtctgcaaaaaacattaatggcagcacctcctcctaagaaattcatcaccatctgataggtaacttcctgtggataggcacttacgcctgcagtagcaatcccatgatcggcagcaaaaactaccatatgaggatttagtagctgtggtgaagtggttttctgaaccattcctattttatgggcaagatgttcaagatgtcctaatgcgcctaacggttttgttttaaaatcaattttatgctgtaattctgatgataacatgggtgtttatagttgttaaatggaaaaatgcaatattagtgaaattcaatgagtctttttcttttgtcttgacacaaaagaaacaaaaggtcaagaccttgaaaattgagctaaaaataaaatatgttctctaaaaattctcaactcgtgcgaattcattattacttttttgtatcaatacatttgtcgcactcagacaggagaattttcttaacgttcacaaaatttatttttttaacgccaattttcaaaagtcaaaaaaattttagcccgcaatattcacttaccctcaaactcactaacccgaaacctgcacctcgaaacttaaaacagtcacgtaagaacattgcgcacttcgctctttactttgcaccacaaatacaaaacaatgacaccaaaaatacttgaaaaaataaaagaagttgagactgcaaaaggcgtggaagtccttcttgcagtagaatcgggaagcagagcctggggttttgcgtcccctgacagtgattatgatatccgttttatataccgtcacgaaaaagactggtacctttccccctgggataaggatgaaacgatagaatttatgacagaagatgatctggacggttccggttgggatctgcgaaagacgtttcatcttttgttaaagtcgaatgcggctttgctgagctggttttactctcctatcgtttataaagcggatgaaaagtttgtagaactctttaaacccttggctgatgcctgcttttctccggtggcggtttcttatcattatttaagcatgagcaagaaatatctggaagcatgcagaagtgatgaagtaaaattaaaaagttatttttattgcttaagaaccgcattaacagggaaatggatcatagaaaaaggaacggttccgcctgtattgttcagtgatctgcttgtgttaaccgatgatataaccagacgaaaaatagaagatctcgttgccttaaaagcaaccaaaggagaatcttaccatcattcgaatgattgggaactgtttgattttctggagagaacgatagcagagaatgaagaaaaatcgaaaggtttatcaggaggaaaggcggataaaggtgagatggagagagtttttagggagatattaaaattataaagtatgaaacaactatctgaaagagctcttaattttttaaaaagaaaagaacgaaaaaaagaattttatattgataaagaggagatagaaaatcttttatcattatatcccattaataattattcagagatccttagatttcaagaagtatattccgggcttatcatagatgataacattattcacatttttaaccctgccgaattaaaagattataagacaatcaaaaccgttctatgtgaagagcaaattttgtttcctatttgtggtggacttttcatttcggaagatggaagaattgctataaaagataatgtcagcaatgattatatcttttattttgaattttttgaaacctttatagaacaacaagctttttttgaagaatatcaagattacaaataccttccagccataggatattatactaagaacattagtttaatttcagaagtacttccagattatgattttatcgctgaatgttctgaccgttataattctctttggaaaaatatttcgaattttgtccacgccagattgtaccctgcaggctacactctaatttttgatggtatttcagaagaagaacgtagttttttaattaaaaggctaaaatcaaaacaaataatataaataattaactaaatgaccatccaagatctaaaaaataaaaacctcgttctcttcgaagccatctccggaagccgggctttcgggctggcaacggagaattctgatacggatatccgtggggtgtattatctgccgaaggaagatttctttggcctgaattacattccgcaggtttccaatgagacgaatgacattacgtattacgaaatcgggagatttacagaactgctgcagaaaaacaatcccaatatcctggaaattctggtcagtccggaggattgtattctgtataaacatccgctgatggatctgctgaaaacagaggattttctgtcaaaactctgtaaagatacctttgcaggctatgcggtttcacagattaaaaaggcaaaagggcttaataaaaagatcttaaatccgatcgatagagaaagaaaatcaattctggatttctgctttattctggagggacaaggttctgtaccgttgaaaaaatggctggatgaattcccctcctctggaggggtgtccgtaggacggggtggtctctcacaggaacattgcggattggtaagcattgatcataccaaagggatgtttgctttattttatgatgaatcaggaacactgggatataaagggattattcagaatgaagaggcaaatcaggtttctgtatcctctgttcctaaagatgagaaaccgatcgcttatctgttctgtaacctggatgcctactctgtttactgcaaagattacagggaatactggaaatgggtggctgagcgtaatgaggaccgttacaatgtcaaccagactcacggacagaattacgacagcaaaaatatgatgcacaccatccgtttgctgcagtcctgtgaacagatttttaaaaccggctctctgacgattcgtgtagaaaaccgtgatgaactgttagatatcaaagcgggcaaccagtcgtatgaaagcgtcatgcaaaaggcagaaaacctgatacaatctatagaaaatcattattctgccaccactcttcccgactttccggatctggataaaacaacaaaaatattaattcagatcagagaaaaactgtatcatcatgggtgataagtgataaatgatgagtgatgaatagtgggactgttgaattgccaatgcttccactctcaaactcaaccactcgcatcccgaatcccgcacctctcacccacacaatcaaaccccgaaactcgcacctcgtaccccttaactctccaccacactcacttaccctcaaactctcccactctcaaacccgaaaactcacttcttcgaagccttcgcagtaggattataatcaagacagattttgatccagtattcaaaatcatcaggtttttggaaacctgagggttccacgtaacaatatcctttaagctgctttcctttcataatcatcggcagaaaaccttttttctccgaaacctcatcttccagttcagggtcatagcggcacatcagattgtcatgactgatgttgatacacatcttcccgttcaccagaaaagacagtccgctgaacattttcttttcttcaatctccatattattttctgcggaaagcctttcacgtacccggtcggcaaattcagtactgtaagccatgattttaattttttgatttatcccttttaataataatggcttcgacaggctcagcctgacagcacttaaaaatttcggctggtattccagttgtcaccctgagcctgtcgaagggcatcaataagcatacctttgttaattattaagcttgagtattaattaaagggataagttgatcgacttttctcttattaaaattaataaaaaacaaggatgatcacactatttctttgtttccggtaatagattgtaaattcaaggataaaattttatttaaattaattattgttttacgataattaactatacatttgcaatatcaatcttcctatcatgaatcagactaaaattattgcaagaattctattttatatctgttccgtattatcgttgggatatttaatcaccgggctctactctctgatctgccttataacagatttttctgttacgccttatggaaacggaaaatacctccatatcaattatccgttgacagaaaaacctttcctgaatattgacaacaattatccgtatatcatcttttcatttctgtcagtgcttatcacatatggaatctttttctgtttggccgccagggttttcagggtattttttcagcagaaactgtttacacaggataatatacggcagctaacgagattttacctctataatattttcattcctcttccactggtgattatcgcgggtttctttgtggaagtagaaagtatcatctggggactggtgtttattcactttatgcttggaattttctgcctgtttcttgcgaatatctttaagcaaggactacatttgcaaaacgaacaagacctatttatttaacatgccaattatagtcaacttagatgtgatgcttgccaaacgaaaaatgcagagtaaagaattggcagaaaaactgggtatcacacccgttaacctttctatcctgaaaaccggtaaagccaaaggcgtccgtttcgatacccttgaagcgatctgtaaaatcctggaatgccagccgggcgatattcttgaatttaaagagtagttgggattcaggatacttgttacgaggtttgagagtcagagtgtttgagagtggagtataaaagttcacttctaacttccagcatccagcttccggcttccaaacataaactttaaactttaaatcataaaattgctgccgaaaggccgcctgtccttctattccccaaacacaacgctatgaacacattaaccatcaacaaccttagtctcacctataaaaatggttttcaggccattaaaaacatttctcttgatatcacaaacggaatgttcggcctgcttggtccgaacggagccggaaaatcttctctgatgaaaaccattgtcggacttcagaaacccacttccggaactctgcttttcaatgatgtggatattgttaaaaaccctgattatattaaacagaatctgggatttcttccccaggattttggcgtgtatccgaaagtgtccgcatatgatcttctggaacatatagctctattgaaaggtattagtgataaaaacaaacgtaaaaatcagattttgggtctgctggaaaaagttaatctttctgatttttccaaaaaagaggtccatactttttcaggcggaatgaaacagcgtttcggtgtggcacaggctctgctaggagatccgaaaattattattgtcgatgaacctactgcaggactggatcctgaagaacgcaatcgtttcaattcattgctgaatgatatcagcgagcaggtgattgttattctttctacccatctcgtggaagacgtcagaaacctctgttcggaaatggcagtgatgaaccatgggcaaatccttcgaaaaggaaaccctggaatactgatcgctgaactggagaacaaaatatggtcaaaacctatccataaaaaagagctggaaacttatgtttccaattatgagatcatcagcagacaattactggaaagagaacttcacatcaccgtattttctgaagaacctccgaaagatttcagtcctgtaaatcctttgctggagcacgtttatttccatacacttactcaaaaactttaatcatgaacactttatttttattcgaagccggacgctcttccaagcactggctcacctatcttgtggctttacttttaataagcctgggtattttttgcggcagccagttcaatctttcggcaggagaaggaatttatctgaactcaccttacactatcggttttatgaccgggatgctgagcctttcggttattttttttgctaccgtttatgctttacaactgttgttcagagaccaggattcaaaatttgacagcattctgttttcttttcctttttcaaaattcacttatctgaaagggaaattttacgcgtattttcttcagacatttttaagtttcaatttattaatgactggctttctcctggggcagctgatgcgtacaggaagtgaaatgcaggagtattttaatatcttgtattacctctacccattattgatcttcgggctaatcaacagtttctttgtatgcagttttttgtttcttatttcatttacagtaaagaagaaactgctggttgtggtaggcggactctttctgtatgtattgtatatgatcattttactattttccaattctccgtttatggcgggaagtctgcctcagtcattggaaacacaacaattttcagctctgatcgatccgtttggattatctgcttattttatgcaggcccgggaccttactgctcatcagaaaaatatccatatggtacctttcacaggctaccttctgttcaacaggatcttatttttcctactctcttttggatttttatttctatctcttacattattttctttctccaatacatcaggacagaaagtaaaaacacggggaaatcttcagtcattttctgaaataggcacattggaatattctactgttgctccagcttttaactggtggagttcattccggcccgtattatctttcgtaaaaacagatcttacctatctgtttaaaagcattgccgttcctgcagtttccattatgctgttattctttgtcggaatggaaatgtatgctgaaattgaaaaaggaatccgccttccacagaagtatgcaagctcaggtctgatctcaacaaccatttcagagaattttcatctgtttggcttactgattacggcttattttctgaatgatatttactggagaagtcaatcttccggattcaatctgattgaaaacagtactttctttgcaaaaaaccggttaactggtcattttgtttcggtcagtttactcctgttcttctttaccggaattgtaatggttcagggaattatttttcaggcagcttatcagtattttcatattgattggaacgcctacctcggtgtttttcttttcaatactttccctttgatcttattttcgggatttattctgttgattaatgacagaatccccaataaatttatagcgctgggagtttccgttcttgctgtttttttattgtcggggccggtttccgggaaaatcattacctatcctcttctcagaatattttcagatttcaaagggacttacagtgactttaacggatatggaatttatgaaaaagcttttgcacaaaggcttgtattcggagctggaatcatcagtctgttgtggttattaaacagtattgctaaaactaaaaaaatacgtgtttccgatttggccttcactatctttctgctaatccaagcaaccattgccggcatattctttatgaaaggatacgttccgaaaaatgaagctcagaacatcttaagttctgtagaatatgaaaaaaattaccgcaaatatgaaaatattccgcagccggatatcactggtattactacagaaatcaagctgtatccttcgaaaaatgcttatcagatcaccggaaaatatatactcatcaaccagaccaatcaacccatcaataagattcttatcaattttaataaggatttaaagcttgaatctgctgtaatgacatcaggaaatgaaagaacgaagattctgcaaaacatcacggaagtttcattacagcaacctcttctgccgggaaaaactgcttttcttgattttacattatcttatcagtggtttgctgtaaacggccatcagccctttaatgccatcataaaaaacggatcatttatgagaatcagcaggtattatcctgtgattggttatcaaaaagattatgaaatccaggataagaaacagcgcgatcatttcaacctggaaaatcgcataggattgaaagaacctgaagctcctgaagtggaaaaaaaagattttatcaaccttaatatgattgtttctaccgagcgggatcaaacggccataggtaccggagatctgataaaaaaatggacaaaatccggacgaaattatttcgaatataaagcagagcagattcctttccggtttgccgtttcttctgcagaatataaagtaaaaagtatgaattataaagggatggccattactgtcttttaccatcaaaaacattctgaaaacgtcagccatcttcttgaaaatgctaagcttaccttagattactgcctgcagaattttggaccatacccatttaaaaccatcagttttgcggaaatttcttcttttacccggggctttgccgctacagcttacccttcagcagtctttatgccagaagatatgatttttcatgccaatatacaggcagacaagaaccaggatgtcattaatgagctggccggacatgagctttcccatctgtggtggggaaacagccggattgatccggatgaccggaaaggcactgtgatgcttactgaaacgttagcaatgtatacggaaatgatgctctataaaagaatgcatggcaaagaaaaaatgatggaaagaatcaaggtacaccagcagatctacgataatgaaaaagggttgtctgaaaatatacccatttataaaactacgggaaatatgcctcacatttcttattccaagggtgcaattgccatggtacagttgagtaatctgataggtgaagatcgtgtgaatacagccttaaaaaactttctcaacaataaccggtatccaaagaaacccacttcattagacctcatacgtgaattttacaaagttgctcctgatgcctcaacccgaaaacagattgacaggttatttaaaactacagaagatatcatttttacttccggtcctgatacggcttccacagaagcaaaattaaaggacccgattgatggattttaatttttttgaaaatatttttcaggaattgtaacaaaataaaatgacttacacctttaaaaatacttcaatgctttgcatttcgcaatgtcataaaagcaaaaatccctcagtttgagggattttttatagtaagaatgaatcttattatgcttcgttagaaggagtctggttttccaccggcttttcgctttgtggtctttcaccttgcggcttttgtccttcaggtcttctctgtccttctggtctgccttgtccttcgtgtcttggtttgccttccggcttcggaggtcttggtaaaagcactttgcgggaaagcttcattttcttacggtcatcatatcccatgaacttcacctctacctcatcaccttctgcataaggaactttgtcaagacgagcccactcaatttcagaaatgtgaagaagtccttctgttcctttagcaatcgctacaaatgctccgaaatccattactttcactactttacctttgtaaacttcgcctacaaccggtacgaaagtaatttcattgattttagcaatagcagcattgatcttttctctgtctgttcctgcaatttcgatgcgtccgatttctccgatttcctcgattgcaataaccgtatctgtatctttctgtaactgctgaataatttttccaccaggcccaattacagcaccgataaagtctttcggaatctccattactaccattttcggagcgtgaggcttcacgtctgctcttggctgggaaatggtttccgtgattttattcagaatgtgtaatcttccgtctttagcctgcatcaaagctttctccatgatatccatagaaagtccctggattttgatatccatctgacaagctgtgataccgtctgcagtacctgttactttaaagtccatatcacctaagtgatcttcatctcctaagatatcagaaagtactgtaaacttacctgattttgtatcagtgatcagacccattgcaatccctgaaacaggttttgtaatctgaacccctgcatccatcaatgccagtgtaccagcacaaactgttgccattgaagaagaaccgttagattccaggatatcggaaacaattctgattgtatatggattttctgcaggaattactgcagttaaagctctctgagctaagtttccgtgtcctacttctcttcttgaagtacctcttaaaggtcttgcttcacctgtagagaatggagggaaattatagtgtaagaagaatctttcgtcgtgctgcgtaattacgctgtcgatcatgttcgcatcttttacagaacctagagttaccgcagtcagagactgagtttctcctcttgtaaagattgcagaaccgtgagctcccggaagataatcaatttctgaccagataggacggatcgtctgaggatcacgaccatcaagacggatattgtcttcaaggatcatctgacgcattgcttctttctctacgtcatgataatatacttttacgaaaggagttactcttgccaattcttcttcgttatcagcatactgagctaagaactcttcaagaacagctttgaatttttctcctctttcttctttattggatggcgtttttgctacttcatatactttatcgtagcactctttccatactttttcacgaatttcttcatcgtgttcttcgtgattgtattctctctttgggaaagcttttcctactttttcagctaatctttcctgagcttcaatctgttttctgatctcagcatgagcgaagttgatggcttcaagcatttcctgctcagagatctccttcatttctccttctaccattacgatggagtctttagtagctccaaccataatgtcaatatctgattttaataaattttcatagcttgggttaactgacaattctccgtcaattcttacgactcttgcttcagacattggcccgttgaaaggaatatctgtaatcgcaatagctgcagaagctgccagacctgccaatgcttcaggcattacttctttatcataagaaatcaatgaaatcattacctgtacttccgcgtggaaatcttcagggaaaagaggacgtaatactctgtccaccaatctcatggtaagcacttcatcatcagatggttttgcttctctacggaagaaatttccaggaattcttccacctgcatagaacttttctctgtaatctaccgttaatggtaaaaaatctacaccaggatttgcttctttgttggctacaactgttgctaaaagcattgttccgccacatttcaccactacagatccgtcagcctgcttagccagctttcccgtttcgatagtgatatccctgccgtctgcaagggtaatcgtttctgtaaacgcttgaggtatactcataaatttgcttctttatactccgtattgagtatgattaatatttaaactctttaaattttcgtctgcaaaggtactatataataatgaaatattaaatttttcgattgcataaataggctcttaaaatacaaaaaattggctatcaatggatgaaaattttactatttatatctgaaatcccgtcctgttcatgatttatgaaaataaaaatcagtttttttgaagataatgtattgaaaaatcctgctgtttttgtattattgtctcaaaaaatgaaaataaggaagctaattgaaaaaatatcggtttcattataaaaaccagtaaaaattattgcaaagacataggctgatgcctatatttgccctacttcaccaaatacaatgctgtaggttaaaaaaagttaaggaattatccttatacagataaatacatgtttatgattaataaagaagtacaatccaaagacaggaattatacggttccattgattaccatcaccctgctgttttttatgtggggcttcatcacctgtatgaatgacatcctgatcccctatctgaagcaacttttcagtcttacctttttcgaatccatgctggtacagttctgtttcttcggggcttactttatcggatctctgatttatttcctgatctctatcacgaaaggagatcccatcaataaattaggatataaaaaaggaattcttttcggaattttcctggccgcgctgggctgtgtactgttctatccggcagctacattttcgtattatccgctgtttctgggcgccctgtttattttaggactgggctttaccgtactgcagattactgccaatgcgtatgtttccttgctgggaagtgaagaatctgcctcaagccgactgaatatgacacaggcattcaatgcattcgggacaaccattgcaccggtgctcggagggcatcttatttttgaatttttctcttctccggatggatccttcagtgcagtagctacaagaattccttaccttattttcgcaggaatccttttgttggtagctttattgatttcaagagttaagctgccttcgttccagatgggtgaagaagaagtggtaaaaggctggggagcactggagttcagtcatctgaaattcggggtgtttgccatgttctgctatgtgggcggagaagttgctgtgggaagttttatcatcagtttcctggaacagccgcagattatgggctttaatgaaatcatcagcaaaaattatctttccctatattggggaggggccatgatcggacgttttcttggtgcaatttcattgaatcaatctttaagccagcaaaaaaaggctgtttatatgcttggggcagcaggagctgttttccttgtcatcttcagtattgtgaaccttactttttctcagatcagctttttcctggtattcatcgttcttaatttcattgccttttttgtgggtaaagcggctccggcaagaacgttatccatctttgcagcgattaatgtagctttattgatttctgctatggtaaatcatggtgaactggcgatgtacagtattctgggaatcggaattttcaattctattatgttctccaatatttatacactggctatttcaggattgggtaaatataccagtcagggatcatcattagtggttatggccattttaggaggagctattgttcctattttccagggctatcttgcagaccagtttggggtacaacattcctttattattcctgtattctgctatctggttattctgatcttcggagcatactgtaccaaatatcttggtcatgtggaaagcactgaagctaaagcaggtcattaaaatcaactttattaaaatatataagcggaatatctcaaaagtattccgctttatttttttcatacttcggaatgtaactttcgcaataaaaaaatgactcatcatacagaacagcattacaatgaaaatacaattacagcttgaatatgcagcatttctattgttaggaatctatgcttttgcccagacaggatattcctggtggtggtttgccggattattccttgcaccggacatttccatgttgggttatacggtcaataataaagtgggtgctttcttttacaatctgttccatcacttcggagttgccattatcatttatcttgcaggaacagccctatctctgccctatttacaaattgccggggccatcttattttcccattctgcttttgacagaattttaggatatggtttgaaatatccggacagttttcagaatacacatttgggaaaaattgggaagaaggctgagtagtttaaggtacaaaaccaacccgtcaaaaattctttgaatttttgcctcccctccggaagagagaattattaccccttcagttggaatactcaatctgtatttaatactctaaatattttgactattcctacagaatgacaaactgcatggatagatcattttacaattcaattgtttcattcagtatgaatctcaatactcttttattataacatgaaaatcaatgatcttaagagacgtaagtgttcttctcaacggttcagaaatttctaaaaaacttttgtgtcttttgcagttaagaatcccttgttatataaaaacaaaaaagcaacctctttcgaagttgctttttgtttttgaaaatctttatagattattttcttaaacctagttcagcgatgatcgctctgtatcttgcgatatctttatttttaaggtaatctagtaatctttttcttttacctaccaatttaaccaaagatttttcagtgttgaaatctttgtgattgctctttaagtgagcagaaaggtggttaattctgaaagtgaaaagtgcaatttgtccttcagcacttcctgtgtcttgtgcagattttccgtgttttgcgaaaatttcctgctttttgtctgttgttaagtacattccaatattgtttaatgattattatgtaacgggtgcaaaattacgactattttttgattctgcaaacattattgatttcataaatcaaatttgatagaaaaaaatgttaaaaaattcttaataaattatatgcaatccaacgaaaaggcagtaattttgcattcgaattacaaatgaaaaaaattatattctttgcagcggttactacttttttattcattggatttacttcggtaaaagcccagaaaaatgctgatgacaaaattaaaaaagtcctttacttcaatcccgaagtagagccggatattgatgaaataaaagatcccaccaacaatgcattctttgatgccgttaccgataatttcagcggcagaaaaaacaagatgcttcgcgctgaagttcagattccctttgacagcatagacaaacagactattgtagattactgtctaaataatgatgctgattttgccattgtttccaaagtgagatatttcaaagtaggttttggcaaatatgttttttccaatcaggtagtggtaagcatgaagttatttggtgccgatggtaacctggtcgctgaaacagatcatgatacctaccggaaaaatatgcgtcttctgggctctaccgtgaattctgttaaaataggaactgaaggtgctataaaaggaatcatcaaaaaactgagaaaactgaaacctacggaagcggagctttaaggtttaaggttggaatatacagcctttcatcatcaatggtcaattttgcttcgcaagtcaatggtgaatttttgctgtagagattaatatatatctaattcattcatcatttatattttaaatatttcctttactctgaattataaaaattttcacattatataaaagcacttgtttacattcgtaagcaggtgtttttttgtataatcaactccataaacaactgatttgcaattaaatattttcaccaaataaggaattattaaatattttttactattttagttcaacattaaaaccaaaatcatatgaaaaatctaaagaaactcagtagagaaaaagcaaaacaagtcaatggaggatcaatggaaagatgcagtgagactaatccatgcacagtaggatggtgttgtttcggaatctgctcaccctttatctgtattgaataagaagcaaactaacaacataaaaatcaaactcatgaaaaatctaaaaaaactaagcagacaagtacaaaaggaaatcaaaggcagcgggcctttcaaaagatgtacagaacattatgaatgtccgggcggatcatgttgccacaacacctgtgttgttaatccatgtcctctggaataatatatgatcattacagacacctgcatttgtaggtgtttttttttacatcataaataaaatattggtttacaacaaaatattttcactcacaattgaataatatagaaatatttgttattttagtctgacattaatctaaactataactatatgaaaaatctaaaaaaactaagcagaaatgctgccaaagaaatcaatggcggcttaggaccgttcagatgcagcataacaagaccttgctctgttgggtattgctgtaacggggaatgtctggatcatgactgtatgatagagccttaactaatctctttatcattatgaaaaaatcacatcttaaaagactcaacagacaggaacaaaaaggaatcatcggaggcgcaataaaaaagtgtggcgacgattcagactgcggaccttacaattgctgtgtaaacagtgtctgcaccttcattcctacttcagaatgtggaccaatttaaaagaatattggactttaaatttaatttttgaacatctgccccggcagatgttttttgtcttatacagaagcattaaagtttaattaatccttaattttgccactttattgctcagtcttaaaaatttgaattatttttgcatatccaaaaaatttcacgttttgaattctagagacgaacttatcttcaaccctgccgatattgccgaaactctcagcgaacttcctgctgatgagaggctgctcgcgttcctgaaggttccgaaagagtacaaagcagaagttttttcacaccttgatcctgatttccaggaagataccatcagaagtatcggaagcgatgaagtttctgaaatcctgaatgcgatgactccggatgacagaacggctcttttcgaggattttccggacgagctgatcaagtattccatcaatcatcttaacccgcaggaaagaagaattgctttaaagcttctcgggtataactcagactctattgcccgtctgatgacgccttactatattcagatccgtaaggaatggacagtaaaaagatgtctgcagcagatcaaaaaggtaggaaaaagagtggaaaccatgaactacctgtatgtggtagatgaaagaaaccgcttaattgatgaccttgccataggaactttactactggaagaagaagatacgcttgtttctgatattacagacaatcatttcgtagcgattaccactacaacttctaaagaagatgcggtgacgtatttcgaaaagtatgaccgcggtgcccttcccattattacggaagccggtgttctggtaggaattgtaacgattgacgacattctcgatcagattgagcagcagaacacagaagatatccagaagttcgggggattggaagcactggaccttccgtatacacagacatcatggactgaaatgattaaaaagagagcaacctggctgatcattctatttgtttcggaaatgctgactgcttctgcgatggggtattttgataaagaaattgagaaagctgttgtgctggccttatttgttccgttgatcatttccagcggaggaaattccggatcacaggcagcaacactgattatccgtgccatggcacttcaggaaatcaacctgaaagactggtggtacgttatgagaaaagagattatttccggattatgcctgggagcaattttaggagttatcggatttataagaatcatgctctggcagcagattggtttgttcgattacggccaatactgggtatatgtaggattaagcgtctctgtatccctgattgccattgtactatggggaactttatcaggctctatgatcccgtttgtcttaaagaaattaaaacttgaccctgccacttcttctgctccatttgtagcaacattggtggatgttacgggacttatcatctattttacggtggccggacttttcttaaccggaaaacttttgtaattttaggcatcatctaacatgccaatatgaaaatcgtttcacttgtaccttctattacggaggcattatttgaccttggactgaccgaaaatgaagtaataggaagaacaaaattctgtattcatcctcaggaaaaaataaaaaatgtatcggtaatcggcgggacaaaaaacatcaatattgagaaaatcatagccctgcagccagaccttatcattgccaataaggaggaaaacgtaaaagaacaggtggaagttttaatggaggattgtaaagtaatggtgaccaatattgacaccattgaagacaattattaccttcttaaaaatcttggaaaactttttgggaaagaagagaaagcccagctttacaatcttaaaatttatgatgtactgaatcaggcaaagctagacagtcctgttaaagcagcatatcttatctggaaaaacccttatatgacaattggttcagatacttttattcacagaatcttatcggaaatcggttttcagaatattttcaaggacaaaacccgttatcctcaaatcactactgaagatctggcagatgctgatgttattatgctttcctctgaaccttttccatttaaagaaaaacatattgaggaattgaaggccttctaccctgataaaaaaattatgatcgtagatggtgaggcattttcctggtatggaacccatattgcaaaatgtgaaaattatttcaaagaattactgaccgaaattcacctcatgcagcagagctaatttttcaccatcaactttaaacccaaaactttaaacattgaactttatatgtctgataccattatattatccgaaggagcagaatttgaccatgttatacaggaagtttctaaatacatccacctgtatgtaatggcatttgaaaaagaagaaagaaccatcacgcgggtagacaggcgcgaaaatatgtatggaggaaagggaacggtatatatgctccagatgtttgatcagaaagaactggccaataaccgtctggccgcctatatggttttattgaacaaaggagatgaatccgggtttcatacccataacctgagaaatgaacaggagctgtacgtagttatgcacggaaccggagaatatcgtgaaagaaccggaacggaaggacccatccggaagaaaattcttcacaaaggagatattacggctatcagttcgattggataccattccatcgaaaacacagggaatgaacctttaataatgtttgtgattacgaccaataatccataaaaaactccgactatcaagccggagtttatattatatcattttgaaactgagttacaaaattttggctacttctccacaaagccattccagcaattcacggtcttcgttggtaaacggattaatggtatgagaatcaatatcgatctgaccgatattttttccatccttaaaaataggaactacgatttctgcctttgtatcgatagagcagcttaaataattgctttcttcatgtacatccggaaccacaaaagtttcattggaaacggcaacctgaccgcaaattccttttccgtaaggaatgatagtatgatctgtaggggctcctacgtaagggcctaaaattaactcgtccttatctccgtttttgaaatagaaacccgtccagttgaagtaggaaatctcctgatccaacaggtggcataccttttcaagcttttcttctgtattatgttttggactttcaagaattgaggaaagtcttttctttaattctgacattgtatatatattttaagagaattgttttagggaaagctcttctttatatccgaacattccacgctctttaatcatttctgctacgccatccggaacctgagtttcccagcctttcacacaacatgcaatttttctcagtatctctcttgagtaaatttccaaaaactccggattataattagtgatatctacaatacggttgttgtgtttgaaatatttgtataattctttcagattttcttctactttcaggtttgaagaatccagcagctgatgtgtttccggatctttataaggatacaggtaaaccctcattccgtttctgaaaaacttcccgaatgcttccaggattcctcctgacagatttttataatatttctcatcgaataccatcaacaggttatttacccccattgctaccccgatatccccacttgtataagaagcaaaataatcgatcagtctgtagtattcagagaaatttgaaataataacggtataccccagtttgcctaaaatatccactctgtcaaggaaatctctttcatcaatatctccgtctgccctcagattggaaatggtaatttcgataaggacttctgtttcttcatgggtacaggtggcatctttgaaaaacatatccatcccgtttttaagcatatcaatgtttactttcgttaccggtctgaagctccctcttaccgcaaaaatatttttcttgtataatacgtctgccggcagcatattattcccctgtgaattgaaaataacagcatcagtcattccgttttttaccagctgaagggacatcagcctgttatctacataggcaaaagcaggtccgctgaaatcgatcatatcaatctccaggttatcttttgcgatatcgtcgtatagagattctactaaagttcttgggttatcaaagtaattgaaagctccgaaaataaggtttacaccaaggttacctaaagtttcctgctggagagtagcgtcattttccttgaattttacatggataacgatctcattgtaatcttcattttctttggtctgaaaacggattcctacccagccgtggccttttacagtcttatcaaaattgatggttgttactgtattggcataagaaaagaattttctgtccggattattatctcttgaaattctttcttcaatcaaagcgacttcataccgaagcattttacgaagtctgttctgggtaacgtacctgttttttacttcttttccgtagatggcatcactaaaatctttgtcataagcagacattgccttagcaatcgtaccggaagctccccctgctctaaaaaagtggcgaacagtctcctgccctgctccaatttctgcgaaagtaccataaatagtaggatctagattaattgttaatgctttttgtttaggagttagtttctgatacattaggacatgaaattttttgtaaatttaccaaaattaaaccaacctcaaaacaaaatgaagttgaaatttttaggaaccggtacttctcaaggtgtacctgttataggctgcacatgtgaagtgtgtacttcagaaaatcccaaagataaacgtttacgttcttccgtgatggttactacggaggaaaataaaaaaatactgatcgactgcggtccggatttcagacagcaaatgcttaccaaccacgaacacactgtagacattgcattgattacccatgagcacaatgatcacgtcattggattggatgatatgcggccactgatttttaaaagcggaaaagatgttccgctctactgctactcaagggtggctcatgaaataaaaaacaggtttccatacgcttttgctgatgttaggtatcccggtgcgcctgcttttgaacttcacgagattgaaaacaaaccttttgaagtattggatacagaaatcacccctgtagaagtaattcattataaaattaccgtctttggatataagtttaaaaaactggcttacattacggatgccggttttatttctgaaacagagaaggaaaaactgaaagatctggatgttctgatcttaaactgtatcagaaaatttgatcctcatcctgcccattttattcttccggatgttattcaattgtttgaagagctcaaacctaaaaaattatttctaacccacatcagccatcatcttggactgcatgacattgaagataaggagcttccggccggaattcaccttgcctacgatggtttggaactcagtttttaaaaatttttattcaaaaaccttttgaacattgaaaaaagttcctatatttgcacaccaatttgaaacaaacatcatgtttgaaatcaacatcaagcccaggtggcggaattggtagacgcgctggtctcaaacaccagttcttaggagtaccggttcgatcccggtcctgggtacaaaaaacctctgaaatcatttaattttcagaggtttttattttttagtaagttaaaaaattccctaattcataaaagttcaatcgtagcagatataatctcatttgaatactcaattaaaaaaagaaaactttaattctcttctgtatccgaaaatccctgaattcttttaataatcaattttcttaaccgatcttcgtgctgatcaccccactgtcccaaagcacctatgacaggaattacactttcaccaaaatcagttaagctatattctacttttggaggaacaacaggataaattttctttgtaacaagctcgtggtcttccaactcttttagctgaatgtttaaaacccttcgtgatgcatccggaatcttacgctgcaattcacttggtcttttatgcccctgataaataaaccaaagcaggcgtatcttccatttgccgtaaagtacttcaccaatcagatcaagaccgcagtttaagttcggaattatttttctctcgtacataatgtaaaattaagcgtatgttcccatttgcacaataggggaataatttatccctatctgaatcgtaattccgtacttgtctgaactgcttttatacctcaattttgtcctataaataattttaaaaaaaatgaaacaatttaattacaacaatgagttatcaggcaaaattgcgttggtgacaggaggtacaaaaggcgccggaaagtcaatagcagaaaggttgctgcaggctggcgcaacagttattattaccgcaagaaatgcacctgagcaggaaaacagcaatctgcatttcattgcttccgacctgagcacagcagcgggatcccaaaaagtagtcagtgaagtgcttacaaactacggaaggctggatatcctggttaacaaccttggttcttcatcaacgccagctggtgggttctctgtattaagtgatgaagactgggagtcaaccctgcaggcgaatttactcgctcctgttcggctggaccggggatttttaccacagatgattgaacgaaaaagtggtgttatcattcacatcgcatcaattcagggtaaattgcctctttatgattctactttgccttacgcagctgcaaaagcagcactgagaaactacagtaaaagcttatcaaacgaagttactcctaaaggcgtccgggtcctgactgtttcaccaggctggatcaatacgacagcttcggaagcatggttgggagaaattgcaagaaacgcaaacagtactatagaagaagcgcaacagggtgtaatggatgcattgggtggaataccttttggaagacctgccgagcctgaagaaatagcggaatttgtcggcttccttgtttcaccaagagccagctatttaacaggaactgagtatgtaatcgatggcggaacagtaccaacaatttaatcatctctaaaaacagaaaatatgaatttaccaaacgtaatcgcaaagctgataaaagcacaaaacaatttcgatagcgctgcttatgcccaatgttttacagaaacagccatagttttcgatgaaggcagaatccataagggaaaagtagaaattgaaaagtggattgacaaatccaataatgaatataaagccaccatggaagcgctggattataacgaaaaagaaaatattctatcagcggaagtttcaggatcatttccgggcaatccgatcattttaaaatttcattttgaaattattgacgaaaaaattcagcagttaaaagtgacagattaagagagaatctgtatcaataaaaagagtccgttttacaaattgtgggacggactcttttttagcttaaatatgaattaagcagtatcagcctttcctatccgacctttccttctgcaaatcgaatattctttgacgtatgttaatcaggaaaccagaaacagataaaattcaaaagtctttaagcccaggaaaaatgccatccgtttacaggcaaggacttcatcagaaaactgctactttttgcgcttataccgcaattgtatcaatccggtttcaaatgtttttgaagtcataaattcaagtgcctgttcaggccggtcatctttaaaaagctttgttccgctgcctaataagatcggaattaccgaaataataaactcgtctatcagctcattcttcaacaattcatttattatttccgcaccaccgtcacaatatatattcttcccttctccggattttaaaccattaaccaattctgtaatatctcctgtatagaaagttgtcctgccttctttcggccttgctgttcttgtgataacataaatatcccgctgtccgttgtcataatgggatgagccgatttctttaagtacataatcataggtttttctcccaataataatagtatcgattccggccgtaaactccgcatagccgtaatcctcgccttctttttcaactattttcagaaagctcagatcatcattgggttttgcaatgtagccatctaagctcatcgcaatgaaaagtgataattttcgcatagattctaatttactattgaagcaaatttacttctataaaaggttctgtactttgtaaaaatgcgacacattaaagcaatgaggggacaagtccggtattccgcctgatttcattggtaagatgcgaatgatcatagtaaccacattcaaacgctatttccaataagctccggttttgatctgaatttttgatcaaactcatagtatactgaaaccttattatgtttgaatattccttaggtgataacccgatcagttttttaaaattccgttccagctgccttaccgtcgtacaatgtattttggccagctcgttaacacttatatttccattggttgaatgtatatgattaagtactttcttcagctggatatttttgtttttgagcctcgaggaaaagaactggtcaaaataagggaaaggattgtcagatgctttatcaacatcaaaggaattgaccttttcaaattcaacagtagcatttgtcaattcattttgtgaggcatagctgtaaaaatttgtaaaagtggcaggtttcagacatactcctgctaaatgggtttcgctgtcgataaaactatctttaaaagaattcatggcacccaccacataagtcttttcagattctattgtgaataaaccattatccgttaaacatttatctcccaaattgataagtataccagcgcagccatccgggaaaactctctcccactgcctctctgtctcatttcctttcaactcccaatagaaatgaataaaaggctccaattccttacaaggcttcatttttttgtactgcatgtttttttcttcagtatagttttgtaaaatttatcttactatgcaggatattacagattttacgaaacactaaccccgaaaatacggcccaccaatgctgtaattcccatagcaacagttccccagaaacaaatcctcaatactgcgattttaatatttgaacctccggctctcgctgaaattgcccccaaaagcatcagaaagatgattgaaaacccgtattggaaatacaccatttgttttataggtgccaatagagaaactacaaacggtaataaagcccctaccgcaaaagaactgaaagaagccagcgccgccagcaaaggtttagcttgtgttatttcgtttattcccagttcgtcccgggcatgtgctcccagggcatcatgttctgtaagttcaatagctacctgcatggccgtttctttggtacagcctcttttttcatacactttggctaattctctgagctctatctccggcatttgttcaagttcaagcttttcgcgcatcagatctgctttttccgtatcttcctgagaactaacggatacatattcacctgccgccatagacattgctcccgcaatcatacctgccagcgctgcaaggataatgatatgtctttcgggctctgctgccgcaactccgataacaatacttgtggtggataataacccgtcgttggctcccaatacggctgcccggagccaccctaccctgtttacataatgtttctccagctgatgatgcataactttttgttttgatagcacgttaaagttaccaaatgtttcatcaagaatcgttttaaattaagccatttcggatagggattttatattttgaaagatgtgtttccgatactgaccttatgataaaaatcaatacagaatgcataactatttttttacgaatcatgatatcactccgtttcaatacatacatttccgttttgtataacctatttatatctggggcaattcatctgcagattttccggccggctgttatccggtatatttttctctcggcgttgtttttcaagatcttcatagaatctataaagccggctttgctcagcttctgtaaggttttctatttccctgcctttatcttctttacgcgcagccatcagttcatcaagcttactctgaagcacttttatatccttattttgtgtattcctgataaaaagtacagcaagtcctgcaatacctaaaaaagcacttcctttaaaatattcccgccaatccggccatctgtctaaaatatcttttatcataacttttattttaacaatttatttaaaaacaagtcatacagattactccatatgacaggtttcaacattaatctaaatctatgcaaactagaagttcttactgctttcaattttaacaatattttttccttcttaaatttgtattgttcttatggctctttctgcacaaagtcgtttattttaaataattactgtattatacgacgattacggaatgctgtaacttgttatctcataacagattgccttcaccgctttatcataagcattaatcatctgggaaaatatacaatcaacccctatttattataatgtcccggtttattatcttaatagaattctgtactgatctccattttaaaagaattaatcctgctttacaaattcaatgactgtaaatatgataattcacttttttaatagaatctacatcataggcaagtccacccatctcacaaggttgatctgatatccgttaaactgaaaaagtcatactgtcagatgacagaattagtctgcggcctggaattctcttttgcagctaacggcaaaaggccaaccagtataatgaatttcatatttaaaaattttatggtgtgtagtttcaaatgtagtaaacatactcctaacgctttatgactcagatcatagaattccctaactgcacgttttccatcggaaaatccgattttcctatctttgcagcaatgaatttattatatatcaactgggacatcaatcccgaaatcgtcaatatcctgggaattcctatcaaatattacggattactgtttcttgcagggcttgttttgagtctaaatatcttaaaacgcatctataaaaaggaagatctcagcacgcaggcccatgaagctttattctcctatgcactgataggaattctggtgggcgccagattggggcattgtcttttttatgattttgattattattctcagcatccgcttgaaatatttttacccattcagaaaggtcccgacggaagctaccactttacaggatttgcaggtcttgccagtcatggcggcggtattggattggtcattatgcttctcatttatgcgagaaaatatactatcccattcatgaccgttctggatgcaatagccattgtacttccgttgggaggtactttcatcaggctggccaaccttatgaattctgaaattatcggagttcctactgatgttccgtgggcttttatattccgtcaggtagatgatcttccgagacatccggcacagctttatgaagcgatttcttattttattattttcctttctgtgtatttcatttacaggaagaatatctttaaaatcggaaaaggattttattttggaatcagtattctgctgatcttcattatgagaatcctgattgagtttatcaaggtagatcaggtagaatttgagcacggaatgattcttaacatgggacagcttctgagtattccatttgttcttctcggattattctttattattaaaagtatattggagaaaggaaagattaaaaccgcttgatttattattccttttaaataaaaactcactgaaagctgcttttcagtgagtttcttttttaatgaaatttacaaagtattatcttgttgtatatccaccgttggcaaagatggtctgtcctgtaatccaccagccatctgtcaccagaaattctactaaaggcgcaatatctttaatatctgtcaatcctcccaacgcagatgctgatttatgataagctacagcatcatccgtttcctgcccgtagaagaaaggagtgtccatcgggccgggagccactgcggttacagaaatacctctggctccaaactctttggaagccgctcttgtaaaatgctctaccggtgcctttgcccctgcataggtggaatacaatccggtgtaggccgccagcaatgaagtaacaatcgtacagattttcccatgatcgttcagttttttaccggcttcctgcaaaaagaagtaagcggattttgaattgacattgaacatggtatcatattctgcttctgtagtttctgaaaatgtttttttaagcaccattcctacagtattgatggcaatatcgattcctccgaaacgggtaatggtttcatcaaagaatttcgtgatatgatctactttggtaagatctccctggaataaaaatgcttctgctcccagtgcctgtacttcagccagtgttttttcgctttctgcccttgagctttcactgttgtaatgaatggccagttttgctccttttgcagcaaaatctctgcttaataatcctcctaagtttttaccgcctcccgcaattaaaacaacttttccttttacattttgtgttgacattgtttttatttttaaatgttaatgagacaaagatggatattaaaaacggcctcagcatggtgaaattttcgggaatttcattttccgatctcatacagaaaaaacatttactttttttatgtaaacaatagttgttcaatagaacgctatttaccagccagatacatcttgagagactcttgtttatttaaacaccctgctacaattcccaaaccgacgccaattttaggcataacatttgataccttcctcccgtatcacgcaccaccacttcatttttaatatatttttttataatcctcaggtttctggggatttttttataagatttttaccactttacaaatacacttatacatacagtatagcgcagcctgcaacactatttctgataatcaatcatttaaaacctgattattcattttattgttgtatatttgtagataataaaccaagtcattactttgttttctgtaacgacacgaatatttttattcagtctttgccttttgagcagccatatttttaacttttattcttctattaaagaacaatacttgtcggaattttaaagctctgtatgattggaaatatccaggacaggaaacatcagtgggctttataggtctcatgcaggccagattgaaccgattaatttatagaaactaaatactaaaaataatttatggcagattctttttctaaaaaggaaaatttcaagaaaaaaattcaaaagcaaaaagaaaaggcgctaagacgcgaagaacgtaaaacgaacaacaacaaagggaaagacatggaggatgtattcatgtatgtagatgaattcggaagattaacttctactccccctgaacaaagacaggaagtaaaccttgatgatattcaactgggtgcagctcctatcattgaagaagatccaagaaaaacaggaattgttacgttcctgagtgaaaagggatatggtttcattactgaagataacagtaaagaaaacatctttttccacaacaataactgtgcagagccggtgaaaaaaggaaacaaagtatcttttgaaaaagagaaatctcctaaaggattttctgctgttgaaatacagcttgttaaataatacatacctgtaaaaatgtttctgtgttaaaagcagatccgttttaaaccatacataaagagactgtccgcgcggacagtctcttttttagggacatataaaaaaagttaacttaacttataaaaagttagattctaacgcaatatcttagaattatttcaaatctccttacgggaacccgtagaatacagttaaaatttataaatataaaagaagctgccatttcagacagctcctctcatcgtaaaaaagtaaaaaattaatcaagttttcctcccaatgctttaaacagcaggacgttatttctggtattctgatgctggaactgtagtaaatccaattcagcggttagtttgctcttctgggaattgatcagctcaaaataatttgcatagcccgtcagatacagatcattggaaacctcaacaccgcggtcaaggaaacctacttcttctgatttcagcttcaaaacacgttcataaattttagtttgttttaaaatagactgaagttcattaaaagcagtcgttatgcttttctgatagtttaaaaaagcaatttcctgctctttgctggctactttaaattcatatttcaactgtcctttattaaaaacaggaaccatcaaccctcccaacagctgtccggccagtgaacctggcttaaagaatgtttccacagaaaaagaattcaggccgaaaccggctcccagatcaattttgggataaaaagcagctcttgccgcctgtgcatcagcctgggaagcttccaagacatagtaatttgctgctacatccggcctggaatggataacattttctacattaatggttttatttaaaacatccatattggtaggcattaataccttacctcgtttcacctctccgccatagctacctgtcaaagttgtgatcgcctgttctacggtaacgatttccacgcgaatgtgctcaatctctgcgagccagttattattctgtgccttgaactgctgtactgccaattcggtagctttacctacttcacgctgagccagaacaatttcaaaggccctttgctgaaggttgtagttcttctgataaatagcaagacgattgtctaaagccaccagctgataatacagattggcaatatcagtgaaaagctctacctgcagtaacctcaaaccttctgttgaagccagatatttcttctgggcagctatctttttatttttcaactttccccatgcatcaatttcccagctgcttctcgctcccagccagtaatttggtgtaaaatccctgttaattttctgatcttccgtaatattgggtgaaagattagtatcatagttaccaaccccttccatggtatattttccataacggttaccggaagcttctattccgacttcaagggagggcaacaggtccatttttgatctttgcagaaaactgttggcaatctctactctttgctgtgcaatctggaaatccggatttgcctgcaccaccttatcaaaaagctcaagcagataaggatccgtaaaataagccttcagattgatctgctggaattcatccgggtttttatttttatctgttttgataatctcgtcaggtagttgctgagcttttttcagctccgttactttgggaacagcacacgaaaccaggctcagtgataccattccatacaatatatttctatgatttaatcttttcatctttcttcttattttcaagttttgcaaagaatatatacagtcccggaatcaccaccagtccgaagatcgttccaatcagcattcctccggcggccgctgttccaatagaacggttaccgattgccccggctccggatgctatacataaaggaataagtccggcaacgaaggcaaaggaggtcatcagaattggtctaagacgctgtcttgctccttcaatggctgccggaatgatatcaaatccctgtttatttcttgccacggcaaattccacgatcaggatggcatttttagctaaaagtccgatcagcatgaccaaggctacctgtgcataaatattgttatccagccctgcagcaaccaatgcgatataagaaccgaaaattcccgtcggaaggcttaatagtaccggcatcggaagaaggaaactttcatactgtgcggccagcaacagatacacaaacaatagacagatggcgaagatataaacggtctggtttcctgataagatttcttcccttgtcattcctgaccattcaatgtcaaatcctcttggcaaagattctttggctacacgttctacagctgcaatggcatctccggagctataaccatctgctggttcaccgttgatcatagcagacatatacatattgtaccttgtaagtacttcagggccgtagaccttctcaatagtaatgaaagtggagaaaggaaccatttcacccttatcattttttaaatataaattcaaaatgctttcaggagtatccctgtgctccggacttgcctgcaccatcactttatacatctggctgaaacggataaaattcgtagcgtaataagatcccagcatggtctgcagcgtagacatggcattgtccaccgatactcctttttttgctgccatatcataatctatattgatcatatattgcgggaaagtagcatcaaaactggtaaaactgttctgcagttcgggcgcttcattgagttttttaacaaaatccttagtgatcttgtctgtattttcaatagttcctccggttctgtccagcagacgcaattcaaaaccactggtatttccgaatccgggaacggttggtggtgcaaagatctcaatctgggcatctgctatgccctttgttttatctgaaagttctgaaatcagatcatttactgaaatatttctttctttccagtctttaaggttgatcatcgccattccgtaagatgaacctgcgatctctgttacgatactgtaacctgcaagcgtggtcacgttttcgactcctttgatcttcttggcgatcactgtcacttcgtccagtactttttctgttctttctacggttgctccctgcggagtggtaacacttacataaaccatcccctggtcttccatcgggataaaccctgttggcaggaatttactggtcacaaaggtcagtgcgatgaataagaacaacagtccgaaagtcactgtagttcttgtagcaaattttgacaaaatgcctacataaccattcgtcagtctttcaaatcctgtattgaaactctggaaagccctgtcaatgattgtcttcttcttatgatggtcatgaggttttaaaataattgcacaaagcgccggagtaagtgtcaacgcattcacccctgaaatcacaatactgatagccaatgttaatgaaaactgacggtaaaatactccaacaggcccatccaggaaagcaacaggaataaatacggcagacattacgatcgtaatcgctactacggctccggcaatttctttggtggcactgatggttgcatccagagcattcattccttcttccattttcacatggacagcttcaacgacgacaatggcattgtcaaccacaataccgatcgcaagaactaatgcaaacagcgttaaaagattgacagagaaatcaagcatatccatgaatgcaaaagttcctaccaacgccactggcacagctagcacaggaattaatgtggaacgccagtcctgcaggaagataaataccacaattcctaccagaataaaagcttcaataagggttgtcaataccgcactgatggaagcatcaaggaatcgggaaacatcataagccatgttatattccattcccggcgggaaggaggtgactttcaattcttccatttttgcctttacactttcgattacttcagaagcattggaacttggacgctgtttcatcatgattgatgcagagggtcttccgtctgttttggaaaccattccgtagttcatcgccccgaattcaactttggcaatatctttaagctttaaaatggttccatccacatcagaccggatcggaacttcttcatattgttttggctcaaaaaactttcctttatatttgataacatactgaagctggcttgaggttttaccagaggtttcacctacttttccgggtgctgcggaaatattctgcttttgcagggaagtaattacttcgtcagctgaaatattataagcagccattttctgcggatccagccatactctcatcgagtattctttctgtcccatgatctctgcacgtcctactccatcaatacgtttcaactcctgaaggacgttaatatccgtaaagttatagatgaactgctcatcctggctgggatccgtactggtgatattaaggtacatcagcatactgttcacctctttttcagtagttaccccggctctgatcacctcttcaggaagctcatccagaatagtggttaccctgttctgaacgtttactgctgccacatcaggatctgttcctacttcaaagaacacctgaataagggtaagcccgtcattggaggttaccgtagacatatatgtcatccccggaactccattgatcgctcgttccagaggaagagctaccgcattggcagacacttcagcattcgctcctgtatattttgctgtaacggttacagaaggcggtacaatatcgggaaactgggtgatcggcattttgagcaacgccataattcccagcaatacaaataatatggaaataaccaacgaaagaacctttcgtcttataaacatttctaccattgatttaaagattatgaaaggttaatacttctttttgattttgataatatcaccgtctttcaaagactgtgttccttcataaatgattaaatctccttttttaagaccgctttccaccatataagaatctcttaaggtagtcccaatcttaatgctggtcattttcactttattctgcttatccactacaaaaacataggtcttatcctggatggagaaggtagatttctgtggaataaggattgcgttattctgctgttcggaaataataagctttccggaagtaccgtgcttgatcagacggtccggattcgggaaaagtactttataccggatagagcctgtagttctgtcgatctctccttcagctgtttttaaagcaccgttgaactgataattggctccattaggcagtgtcagttcaatcttctgatgattcccgattttatcattagccaaaagctcaaaatacaggttttcaggaatcgaaaagtaagcatatacttcgttcaattgggaaagtgtggtcaataatgttccgttttccactaaactaccgtccttatggggaatcacatcaattaccccgtcaaaaggtgctgtgatttttgtaaagcttattttctgaagaactgctcttttttcagcatcagcaaaggcatgttttgctttcgcggaagacagttttgcctttaccatttccagctcgttattggctacaaatttcttagcatgaaggctctgaatctgcttcaattctacttctgcaatgcggacatctgcttcagtctgttttaaagcggcattcgctttcaaaagctccatttgcaattcagcatcattgattttgaataaagcctgcccctgatgtacaaactgtccctcgttgacataaatatgctgtataatacctccgattctggaacgcatttcaacattctttttagcctggatatctgtgacaaactggttgctcaccaatgtatctttttctttgatttccagtacgggaacttctttttctttctgattgtttttttccttgtctttactgcatgacacagcgaataatgttgcaagaatgcaaattattacgtttttacaatacatttttaaatgtttaaattataagatttccgttaaaagtgatctggctttcagaaatttaaacttagtacagctggaggagatggagaaaggatttaaccccgcagataatggaaactgcaatttccggaagagcaattttcggaataacttttaatatccctgaaaagtctgccactgcagaatcattttttctaactgagtgttttacaatttttgaagcagcaggcagcgcatgcgtgttcatatctgcttcttcataaacatccagaacgtgaatgtttgttacaggaggaacgtgaggaatattctgcaacgatttttctgcccagttcgaattgaaaagggaaaaaaccagtatgatataaaataagaaaaatgacctcagacctgccatgtcaatcagaatactttagtttttcagtaaaaacgatagtgttgcaaaaatagagatttttgtgggaaaatccagtcacagaactgttaaaaaaacttaaacaatggatgaataattctacttattcgtgtcgggattcctaaggaatgacaagtagaccgcgaagtctattcatgcagtctgttattttgaagcaatctaacttctaaaattccggatgaaaaatggcattaagtttcggctaaaaccaatggaattttggttatcatttttaaacgggctaaagcccgtttctattgcatcattaaattgtatactaaaacaattttctgagaactctgaaacgataatcaaagatatattccagtttctttctgacgaaaaggcgatgggcaatctcacctaaaaaacccataggaagttcataatttatagtatctctcatcaaaacgccttcttcattaggaataaattcatgatggtggttccacagcttgtagggaccttttttttgaaaatctatgaaacttttctgaaaatctacgtgggtgatctcagtctgccatttcatcttgatcccgaataggggcgaaacataataatcgatgagcattccttcatagatttcatcatcttccattttcgtcaatacaataaagcccatgtctttcggagtgatttctgaaagattgttggctgaggaaaagaatttccacgccgtttctatatcacagttgagctgttgttcacggaaaagtgtatgtttcataaaacggaatcagttaacctaagtgttatgaaacaaaggtataacaaagatttaattatagatccacattaataccggttttccggatttctgaatcatcggatctatttccttcattgccttgttcgatacggttggacagccccagccttccggtgagccttttggaaacacctcttcatcactcatcagattccaggaatgaaagacgatatacctttttaaagcattgctgttggtttcttcaaggccgtgcatcaggtattttacattgataccccactcgctgtaccctcttccttccagtttatatttccctaaagaagacagatggcttccatcttcattactgaatccgggattggctttagaatcatctttgctccatgcattggaaccgcagccatggcctacgagatatttttttgaaattttattgtttttaaaatcccagacaaaaaaacggttaaccccggaatgaaggctcatatcaatcagaatgcagaaatctttgctgagattttttgaatcacagaatttcaatgcttcttccgctttactttttattttggaaagattggcttcaggcttcttttcagcaacaacaggggtatcaaccgtctgtattgtatttctgtttttttcctgaaagcatgaacacatccaaaaaacaacaaaaaacagataaattctcttcatgaattatttatagtgctgaaaaattccaaaatctgtaggtgtccaaagtgccgctttttgtccggcagcctttaaagcgttatttgaccaagtattacaggtgtaaagaaaactataagttcctttggcatcataaaaggcatcattatcaccatataccgcattggttggaattaatatgaagttaccgttctgatctctgtcaaacttatcttctacatatttcaccaggttttcatactgccctctgctgatcataatcatcttacaatcttcaccttccttcattgtattatagtaagtacaatgcatggcagaatcacttaaccagaaggctgctttaacggctgtagaaaacttaaggtcagcccaggtaggggtatccagataaaaacctttgtctccccatcctattcctacatactgatagtctgttttttttgatttcgtattggcaaagggaattttccggctccagtcctgaagatcgtttttcaccggcattactatatctgtatgcactccattggtataaatatagatcgggacttctttcttctgtccgtcatcttttgctgaaacaggaatataaggaatcagcagtccaaggattacataaataatcacaattcccaaaataatgcccaccactttcaggagatacattaagatcattttcacagtcatgttttttaataaaatttaatctgcaatttttggtaaaagtatttgttttaatcgaaaaaatggctatatttagttacgaaatattcagaaatatgcgtaaaaataccaaatcccaaaaaagatttaaaataagagtaaaaactgctcctaaaagaatacaaaaaagacgttgattttcggtgagatcctaatctcctgaaaatcaatttttctttataggaaaagcttttcaagaaacttattgatgtaaatctttacctccttaaagcggaaagtttaaggaatggtcggttatcagctctggtttggaaattcaaaaaattccaaaggaggaattgtcaccgaaagttccgggaaaaatcagtccgaagacttctgtaaaaactcaatatttctcttgagccctgcaaatttggtacgtttcacgggagattttctgaaaatttcggagaaaatttcctgagtaagctctttccattctccttttttgaagtttttcaacgcttcgttgggctgaaagcggctttgtttattaggcgctgagaaacggttccaagggcaaacgtcctggcatatatcacagccgaacatccagtcttccattttatctttaaaatagtcgggaatttcgcttttgagttctatagttgcataagaaatacatcggcttccgtcaataattttttcagaaactatagcatccgtcgggcatgcatctatacattttctgcaggttccgcaatggtctgtggtggcatgatcaggaatcagttcaagatcacagataatttctgccagaaagtagaaagaaccattttgtttggtaataagattggcatttttccctacccagccaattcctgattttctggcccagcttcgttccaacaccggtgcagaatcaacaaaaacccggaatccaaactctcctatttcttcctgcagctctgctaccatctcacggagaatttctttgattacttcatgataatcttctgcataagcatattttgagattttataattctcaagaattgaaattttctcctcgggaaagtaattgtaagaaagtgaaattacagatctggatccttccaccagaagacgcggatcaagtcttttgtcgaaatgattttccatatatttcatttcgccattatagttattcttcagccatttttcaagatgaggggcatcttcctccagaaaatctgctttggaaataccacaactctggaatccaaaactttttgccttggattttatcagttgggaatatttttcggcgccagcattcattaatttcacaatgcaaaattaagattattttatcaatctgatcattgacaccgaagttcggcttacagttggcttcaggtctcctattttctgaaaatttatattttaattaggatttttttcaaaaaaaaattgcgtaatttcgtttctgattttaaaataaacaactatgtctttaatagaagtaatacaatccggaaactatgaattgatcgacgttcgtgagccaatggagcttgaaatggacggcagcatagatggagcaaagaatattcctctgggtgaagtagaagatagacaagatgaaatcctatctattgaaaagccggttatcttattctgcagaagtggaaacagaagcggaaaagcattggattatcttaacgctcaaggattaaaggacggttataacggcggaggctgggctgagctgaaggctgttctggaagcaaatcagggaactttttaaaagttcctttttttatatctttatttctatgaatctgaaaactcgatttgaacagctatgttctccttttacagtagacagacagctaatccacaatctctggaatgaaattgaaaccaggtattctgaaaaaggcaggtattaccacaatcttcttcatcttgaaaatatgtttacggagcttgaagatgtgaaaggtaatatttcagatttcacagggatttctttctccatattttatcacgacatcatctatgatgccacatcgaaatccaatgaagaaaaaagtgcagctactgcagaaaaaagacttgctgagctgcatctaagtaaagatgatatttcagtgatttcggaacagattattgctacgaaatcccatcagctgtctgatcataacgataccaattatcttctggatgctgatctttctgtgctgggtaaagattttaaaacttatatggaatacacccggaatataagaaaagagtattctatttatcctgattttctttataaaccgggacgaaaaaaagtccttaaacatctccttgaacttgaaagtatttttaaaactgaatattttaaggaaaaatatgaggttcaggcaaaagagaatattgaagctgaactccggttactgtaactgcaaaatgcaagatccggttttgtataaaacaaagacatcttagtgataagatgtcttctttttatattgttgacagattatgagtatttaccgataaattctgccgctttccccaatacaagctcaggaacttctttatgcggtgtatgtccgatattgggaataatgtatttctcagcacttccactcacctgagtaacggttttttccacctgatccaatgttccatattcgtctgcttctccctggataaataataatggagctgtaatctctttcaggagatattcaatattccaggttctgtaatcatcccttgtccaggtttctgtccatgctttgaatagtgtttctaccttatcagcatgatacttctgtagccgctcaggaagatttgttgttttgtaggcttcccatgcatcataaacaccttttaaagtaatgtcttccacaaaaatatgtccggcttcacaaataacagcttttattctttcgggatattttgcagctgtgatcagagctatcgtcccaccatcgctgtgcccgaacagaataacgttatcaatattcatttcagccagaaggtcattcagcaaatcggcttccaactccatataatttaccggtctttcatgtgtgaacatggggtatgattttccatatcccaaacggtcataagcaagagtattgcactgcacggcttcagcaagctttaccggaaaatctctccaaagctgcacggagcctaatgaatcatgcagaaaaacaattgtgggcttgtctttaaactgattattgtgttctatatataattttttgtcctttacatcaattattcttccctccattgaatacaattatatttaaaacgttggcatttttgtttcttcaaattcttttaaaagatgattgaagacagtttccaccggaagaatctcatcaattaaagctgaaacctggcctatttcgagttctccgtcttccatatctccttcaaacattccgcgctttgctctggctcttcctaatgaagcgattaaagcatctttgtttctaccgctctggtagatttcttccagctcattaaagaatttatttttaaccattcttaccggtgccagttcttttagggtaagatgtgtatctccttcctgaagttccgtgattttctttttccagttttcatgagcgctcgcttctgtagtggcagcaaaacgggaaccgatctgcacaccgtctgcaccaagaatcattgcagctttgatctgtgaaccaagggcaatgcctcctgcagcaattaacggcttagaaatatgttttttaacattgggaataagacagaatgttgttgtttcatctcttccgttgtggcctcctgcctcgaaaccttccgcaacaatagcatccactccggcatcttcacattttacagcaaatttggtagaggaaactacgtgagctacttttattccttctttctgaagagtctctgtataggtcttagggttaccggctgatgtaaagacaatcttcactttttcttcaagaatgatctgaatgatttcttcaatattgggatacagcataggtacattcaccccgaaaggtttatctgttgcctgtttgcatttctgaatattttctctgaggatatcaggatacatacttcctgctcctatgatacccaatccgccacagttggaaacagccgaagcaagtctccatcctgaatgccagatcatgcctgcctggataatcggatatttaatattaaaaagtgtcgaaattttattttgagttgcctccatctcatgaagtttttttgcagcgttgaaatctataaaattgctcatgcgtaaaaataataaaaacaatggttttccgggaaatatctgtcaatattttccatggtggattttagtctttataaagtttaatgataaaaaaaaccttcagaaattctgaaggttttaattttattttgtcaaggattgtttcttccagttagacttaaagttacagctgtcgtaacgtccgtcaattgaaataaaagttgtcggtaacttggagttgacaaacttttcaaccatttcgcttttctttttattcagcgccatttgtttgattctgctgaagtctgtttccagcgtaatctggtgagaaggaatcacatcttcaattttgatgatcttgatttgctttctcttgttttcttcgtcttcaaaagcagttgtgatatctcctttgttcaatccagccaattcatagctgattgttcccgggatactttctctttcaattttatcagaaccatcagctcccggaattactccagcattgaattttgttcttttatcatctgagaatttaaaagcagcatctttgaatgtcattttaccatcaataataagacctctgatactgtctaattttgcttttgctgttttgatctcttcatctgttggtgtagcttttagcaagatatgtcttgcatcatacactttacctgatcttttcaccaactgaataatgtggaatccgaattcagattcaacaggatctgaaatttcattttcctgaaggttcaatgctgcagcctcgaatggctttaccatctgtcctttgttgatatttttatataatcctccgttagcagctgatccttcatcttcagaataaattcttgcctggctttcaaaagtttccccggcaaggatatcctgcttgatttttttcaacctgttgataagatcttgtttgtgagcttctgtaagggatggataaatcataatctgagccagagtaacttcgtcttttacctgtggcaactgtgttttatacatattgtagaaatcagttacctcattcggggttacgtctgctttatcggtaactctctggtactttgcctgcccgtagtactggtctgtgtctatcttttcgatagcatttttcatctcataagcatttctgaacttataagcggccagcaatgttttttcatccggaaattgagaaagcaactgacggtatttagcattagcctgttctttgatggctgcagaacggttttcaattaaggtatctttttttgcttcgtatacaagaagcttattgctgataaggttttccaggaactcacatttgtctgtgttggcagctccctgctgtttaccataattcatctgctcgattacatcagattccaatacaatctcatctccgataacagctgcaataccatccaccaaatctccttgttttagctgggcattcatcatatttgaagagaatatcatgatgaaaatcccaagaagaaaagtgatttttagtttatttgtcattttactattttaacaagttgcaaatttagaattcttaacgaatttcactcaattttttattataaatatttcttaaaaagacttatttactgcagttcaacatcaaatgtcgttaattctttgaattgtctcaatctgctgaacatatctgcttcatttacttcttctattctttctgttccgaatttctctacggtgaatgaagccattgcagatcctacgataagggcagacttcattgtttcgaaatcaatttttccttttttagcaagataggctgcgaaacctccggcgaaagtatctccggctcctgtaggatcgaaaacatcttccaatggaagcgcagggatagcaaatactttattgtcatggaaaagtaaagctccgtgctctccttttttgatgataacgtattcaggacccattgtgtggatctttttagctgcttttactaaagaatattctcctgaaagctgccttgcctcttcatcattgatggtgattacgtctgttttggcaatcatatccatcagaatatcccatgcagaatccatccagaaattcatggtatcaaggataaccagcttaggacgcttgttcattttttcaagtacagataactgaactccagggtgtaggtttccaagtaacaaaatttcggcatcctgcattgaatcagggatttttggatcaaaattttccagaacattgacttctgtagccaaagtatctcttgtattcagatcgttgtggtattttccggaccagaagaatgtttttccttcttttacgatttcaattccttcaatgtttacatctctgttggtgaacatatcaagatgttcctgtggaaagtctcctcctactacagaaacaattccggatttaacgcctaaaattgatgaagtgatcccgatataagtggctgcacctcctaaaattttgtccgttttaccaaatggtgtttcaattgcatcaaatgcaacacttcctacaactaaaagtttcatatatttttcaatgtatattaaaagtaaattattttttccattcaaaagtgtccagcaggtgtttcatatcatttttgatatagttcaccgcaggggcaagagagtccggtttcggtctcgtgttaaagtataagtaagcagttacgaagtgtttcgtactgtctgtaatgtagaattgaagattggaagcactttgtcctttcagctcatagaaattcccatatactttcttttcaggatattcaaaggatttcgtatctatggaactggctttgatggtatgctcatataccattttctcagcttctttaatatggtctgcgaagtcgttctgtatcggataataagtaacgaaaattttggctttcatttttgggtagttcaggtagaaccagcaaggctttttggctggcgctatggaagcaaagtccgaatactcgaaggtataggcacaatcgttttcaaacttctggtatttcggtgcaggatattccagacgcaattctccataaggttttggtgaagggtcttttccacatgaaattaaaagcagcgatacaaaaataaaaatgacttttttaatcattttgcaaaagtacaaattagatttcagatttaagaagacaaatttcagtctttcagagcgttttgaatgtaaatttccagaggcttcggaaaggatttttcatgagagccatcaagatctgtaatcaggtattgattttcagcgataaaatcactccatactttttctgaagtgacctcaacattccatatttcaatgcttaaatttttgtgggtcagtttatgggtaatggtttttgaacctgtaataaatggttccatatcagaaggaatagctgccggaaattcaaacagtttcttccagataaagtcgtctgctctctgacggatcaggaacttgccgtttctttgtacaaaataataggtcagagcaagatctccggcttttactttttttgtttttaccggataatctgaaattttctgcagggaaaatgccaggcagtcttcattgagaggacattctccacaaagtggatttttgggcttacaaatttctgaacctaagtccatcatagcctgattaaaatctcctacattttccggcataaccaaagctgccagctcagagaaataggtaaacgctcttgaatttgaaatatcgaaatcatcagcaaaaagacggctcaggacacggtagaaattcccgtcaacggcaggcattcttcctccgaaacaaatgcttgaaacagctgcagcagtatattttcctacccctttcagttttaaaatttcttcatattggtgaggaaaaactccctgataatcattcatgatctgttgtgcagccttatggatattgattgctcttgaataataccccaatcctttccaatacagtaaaacttcgttttcttcagcttctgccaacgtttttacatcgggaaatcttttaatgaaattattataatgattcagtccctgattaatccttgtctgctgaaatacaatttcacagatccagatcttatacggatcttttgtctgtctgaaaggcagatctcttgcattattcctgtaccattccaaaagccggttccctatatgaagaaactctgaagctgttttatttttttccaaaaaccaatcttgttttaaatcattgaagagattgtttctcttcatcttattttcagtgctgcaaagataggtttattttattttttctttacattgtataccggagcagcttttaaccactgatatttaagatttctgtcttttgcaataaagcggtatccttcaagctttttcagataaacatacatagaatctgtattttttatctttagtttatattctgataaaaacagcattggcatttctacagcagaatctcttactgttttcaatacttttcctgattttactttataaagaaagaatgatttcccacgccctttggagctgtccgagagcttaacctctgaacttgcaatcaccagttcactgccatcaaagcattcatcttcattcatgacatatgcttttccttcctggtgttcatctgcaaaaagatcgttttcgtaatgacccggactttggtattttttttcacagcttatcataagtaccatcagcagagccggcaagacaaagatcagcttcttattcatattacatttcataggtgttggttgaaaaaaaaccgatgtaaaattgcatcggtttttgttatataaagtaagtttaattttactcctgagtatattctgcatcccattcgttaccatcatctcctttgtgtccgtcaagtttaataacgaaactttttgtagggaaataaggtgtcatacggatatccagccatactctatctttgtttactctgtcctgctcgaaacgaacaattttgaatttctcgatcagcttgtccggtcctttgatattatccaggaacgttacaatctgtcttcttaaatcgtcttcgtttttagcattccagttttcgaaagctcttctgtttaggaagtcaagcaatactttggttacatagtcgaatacacgaactacagaatacgtctgaagaccgatattgtctcctgtaaacaatgtctttgcagagaaagccataatttttccgtattcgtttaccattggtactagacccattttttccaactgagaaatttcacttttcttcaattcaaattttacagcgtctacttcgttgatattaccatgttttttacctgctgctacctgagacatcagtgttttatgaatttttcctgctaatgaagtggaaggcggaagttctacgttttcctcttctcctacttcttctgctttgccacgtcctaccagccagttacatgtcatgataacgttacttctgtgaagttcacctcctgtaaggttagcagagtggaataagtctacaacgtcatccggtttatcaaggttggcgaagtctgtaaccatcattactttgttttcgttacagatttttgcccatttctcaattaccttatttgatcctaaatatcctggtattgcaaggattgaatagttatctctaaggtcaagacggtcgtaataatttttgaattcttctgaaatggcatcaatgaacaaaggattatccagatcggaaacctgttcaaggcttgcattgacgatacttacgttatccactttatccaattctgtatttttatagaattgcgctactgttctgtagttggtttccagcatacgaacagcgtccagtgtattttttaagttcttttttaagttctgatcggcctgttgtgctttggttttgcacgtttcagccattttatctgctgattcattaccctctaaaaggcttacccaaagattgatcttctgaagaagttcttttctttcttctgctttattgctgtcattcaggaagatttcttttcttgcctttcttgttgggttcatattggcaataccgtctacaacggattcaacaaagccaaatcctcccattttattgagctctgcaagcgggttgcccttcggctgccctgcgtgttgctgctgcccctgctgctggctttcttgtgcctgtaatttgctatccatgatttaatgtaagtctttaattatttttcaagttcttgtgccacttctttcaatacttctatgaacgccgctcttgtctgatcgttctccagcatattgcgtagaattttgttggttttcagctgacgtactattttattgtactgctcctgctccatgctcagctgctgcagataatctgatttctgagtaaggcttttgggagtaaagtctccaaggttttgaaaacggaattcttcttctaccactccaccatcttctgtttcgtgctgtaccgatactgaaggctggaaatgtctgaaaacgtcttccactgtttttaatcctgttacgatttcaggggtataagactcttctgttgtaagttggcttactatcagtgatttattttcctgtatttcctgaatagcttcattagcgtctacttttacctcgtttccgccaacaccataattaaacattgccatattattgttattttgagatttactattttggtttggatctgtctttgagtaatttacagatgaatcgaataaattaccaatccaatgtttaaatttaaaaaaaaactgtaacatacaaaattttactaagatttttcttgaatcatgtaaatttataaatatttattcaacataaaatcaccacattacgatatcactaagctatgaaaaaataaataaactcattcaagaaaaataaaataaaatttctgtctgctttattccctgcaaatgtaccaaatgaatattaaaataagaattccttaagctttacaaaaaatattctttatatttaaacaaagtgaaccttgtcatgaaagatgtaaaaatagcgtttagaaagcccatatttcctgtttcagaagcattacatcaatatctggaaaaatacaacagaaccaccaagatcaaattcctgtatgaagatctgctgaggttcagtgacagtgtgaacattctggataaagacggcaaagatacgttgtggcttggagtaatgtattctgaatttgagtttaaagaaatagaagccaacttaaataaaatttataccctactccattctgacggggatacggctacgctaccttatctgacagtagatacgatcgatttttgtactttcggaaattcaaaacctttccggatccgggtgagaaatgtactgaatgataattatacttatttttatattaaacaggcggatgcctcacgaatattcggattggagtttgaagacctgctttctcccaaccggattaattttctggtgtacaaaaacacgttgatagaagagcatattttaggaattccgggagatgtttttattcaaaagcatttatccagctgttccgaactggaaaaggcacagatctccaaagaatttgtaaaattcaatgaacgctgtcttatcggacttcttggtgatatgcgctcttataattatgtggttattcccatacatgatttcgaccaggttatttacagaatccgtcccattgattttgatcagcagacttatgaaggaaatctgaaagtctatcttccacagtatttcaaagaaaacaatcagatggtgaacatggtactggaaaaactgaagccaagctctattgaacagtaccgtaaagaagtacgttcccagattgtaaaaagggtgaccagcagcaaaacccggtttgatgaacttatttctattatgaagaaagataatattgcacctgaagctaatgtcatcgagttaagaacagctttgcaaaagcttacctatgatgttaatttcaagtactgtaaaaccatgggtgacattatggaaaccggaatcaagtttgtgctccggaattataaaagagaatactaaaagaaaatccatctcaagcaatatgaaatggatctttcttttctaacaatttaaggtaaaattaccagatttttattctgtcctgaggagctttatacattttatctcccggtttgatatcaaatgctttgatgaatgagtcctggtttaccaacggaccgaaagccctgaacattcccggagagtgcggatctgttttcacctgattgatcatatactgatcggtagcttttgttctccaaaccgtggcccagctcatgaaaaacctctgatcctgcgtgaatccgctaatttttccagggtttccgtgatctttcaggtacatctggagcgcatcataagctacagctactcctcctaaatctccaatattttcaccacttgtgaatttaccgtttacgaaacttccttttacgggttcataagcactatactgagctgcaagttgtcctactttggcatcaaagtttttacggtcagcatccgtccaccagttattaaggttaccatctccatcgaaacgggaaccactgtcgtcaaatccgtgagaaatttcgtgaccgataacggctccgattcccccgaagttcaccgctgcatcagctttgggattatagaaaggcggctgaagaatagctgcagggaatacaatttcattgtttgatccgctgtagtaagcattcaccgtttgcggagacattccccattctgttttatcgaccggttttcctactttatccagacttctctgatactgccatgctgccacattctgaagattagagtataaagttgctccttctttcggagattctactttcagctggctataatctttccatttgtccggataagcaatttttacggtaaacttggataatttttcctgagcttttactttggtttcaggagacatccaatcgatattggcgatgtgtgttttgaatgattttaaaagataatcaatataggtttccatctgctttttagcttcaggagtgaagtatttgtctacatacagtttcccaaaagcttctccaagaacaccatttacaagggtaagccctctcttgttcatcggacgttgttctttttgcccctgtaaatatttcgcatagaaatcgaatctgatctgctctaagctgtcatcaagattgcttgcattcccgttgataatgtggtatttcagataatctttcaataatggaaggtttttctgagtaacgaactgatccatattctggtaatatttcagttctccgatgattactctgtctgtatttacgcctgcatctttaagatattttgcaaggtctacatttttaactagtcctgatagttctgatacatttttaggattgtatcttaaattagcatctctgttctgttcaagcgttaataagtaattggcaagctgcttttcaaagtctactacattctgcgcagcctgagtattatttttatatcctaaaacaccgaacagttttccaacataggtctgatattcggccaatgttttggtattggcatcatttactttctggtaatagtctcttcccaggccaagatccggaccaccaagatacactgcattcatgttggaattcttcatatctgctcccactctccatccgtagaaagaattatctcctaatcttgtagcttccaacaggtatttctgaagatcgccaagagttttaatagcatctactttggcaagatcagctttaattggtgtcagaccttctgcatttcttttattggtatccataaaagacgcatataaattctgaattttctgtccttctgatcctgcaggatatgattctgtaagaattttatttaaaatatctaatgaagcatcatctacattttctctcaatgcattgaaagaaccccagttggctttatctgaagggatctgagtagttttcacccagtttccattcacatagctaaaaaagtcatcctgtgggcggacacttgtatccatatatgataaggtgatcccctcttctttcacttcttctttcaccggctcagccacttttgctgtagcttcagttttattctctgtccctgcagtcttagctgcaccacacgaattgagaaatacaatacctgaaagggcaagtattccaatatttagctttttcattaaagataatttttgattttacacaaacttatcaaatatacaaactttaatgatatgtaatgaatggtaattgataattcagggtttaatgtttagagccaccccagcaaaatttttttgaatttttgctacccctccgagggagggaatgatggaagccgttatgacaaaatataagtcagctgatcaaccctaatccctaacttctatcatctactctccaccaccttaaaaaaacaaaaccgcccattgctgagcggttgttatttttaccagattttgattctgtcttccggagctttgtataatttgtctccttttttcacgtcaaatgctttgtagaaagcgtcaacgttgataagcggaccaaaacttctgaaatatccaggagaatgcggatcagttttcacctgattcaccatatatttctcgcttgataatgttctccaaaccgttgcccagcttaggaagaatctctgatcctgagtgaatccactgattttccctgggtttcctttgtctttcagatacatttgaagggcatcataagcgatgtttaccccacctaagtcagcgatattttctccgtttgtgaaagttccgtttacaaaagttccttttacaggctcgtatttatcatactgagaagcaagggcctttgttgctttttcgaagtttgctttatcttccggagtccaccagtctactaagttaccgtctgcatcgaactgtgcacctgaatcatcaaatccatggctcatttcgtgaccgataacagcaccgatacctccaaagtttacggcagcatcagcattcggattgaagaacggcggctgaaggatcgctgcagggaatacgatttcgttatttaccgggttgtaatatgcattaacagtctgtggagtcattccccattctgttttatcaaccggcttgcctattttagctaaatctttgttatactgccattccgtaatattctgaaggttcttgtaaagacttcctcctttagcttcagaaatgatatctaattttgaataatctttccatttatcaggataagcaacttttacagtaaacttgttcagtttctgcattgctttttctttagtggtagaagacatccatgttaagttattgatatgaacagcgaaacttttctttaaatagtcaatcagttccaccatctgagcttttgcttcagcagggaaatatttctcaacatatagttttccgaaagcttctcccaaagtaccgttgatcaactcaaaacctcttttgttaagagctctctgctcctgctgacctctaaggtatttgccatagaaagcaaacttcatgtttcctaagttttcacttaagtaagaagcacttccatgaatcatgtggaatttcaggtaatctttgatcacagaaagatcctgagcattgatcaatttatcaaagttcttatagaatcctaattcgctgataattaccttgtcagtatttactcctacttttttaagatattcagggatatttactccttttaccaacgctgaaagttcagccattgttttaggattgtactgaagggtattgtcacggctctgctcattggtcaggtatgtattggcgatacttttttcaaagttaacaataccttttgcagcctcatcagcatttttatatcctaattcttttagcattgaagctacatatttctgatattcagcgatagcttcagtatttttttcatttactttctgatagtagtctcttcctaaacctaaagtagggtttcctaaataaacagcgttcattttagaatctttaagatctgcatcaactccccatccgtaaagaatgttttcaccatctttggttacagaagtcaggtaattctgaaggtcagccatatttttaatggcatcaattttattcaggttatcctggataggtttgattccgtctgcatttctcttctgcatgttcatataagtagcatacaggtcctgaatctttttaccttcgcttccgtcagcaaatttatctttcaaaagggagttcaggatggtcatggaattgttatccgtatcctcagcaagtttgttgaagcttccccatgttggtttgtcagatggaattttggctgttttcatccaggttccactcacatagttgtaaaagtcatcctgcggacgaactgaagtgtccatcaggctaaggtctaaacctttgtctgtgttattcactgctactttagcagctttagcttgtgcgctcatagtcgtttgagtgcagatccctgctattaaaaacaaagaaagcgttatttttttcattatgataacaatttatagaatatgtatgatttattttgaatttgttacttttcagaaaaacaaatttaaataaataagttggaagccggaggatggaagctggaagttataaaagtgataaagaatagtaatactatctctacaatgagtccctgcttattcttctcacctccggctttatctaagaagttgctatctcttttacatttccggttcttttcagaaatccccaggactgcatttcgcctttcaatgcttttcttaaacttttaaataatacgatatacatcagccatctatacccgaatctctgcggaataatatacaggagattgatcagtttttcacgctgcatgatgaatgcaatcaaagctaaggaagcatccaccaaaaggaagatcagataataggtaaatattttatctccgtttccggacaggattccaaagaacataatcacatctgccaatggcgagaaaaatggtataatatattggaatagtaaaatattcggcattgcccaaagtcccaatcctttatatctggggttaaggaaagtctgtctttgtttccagaacatctgcatgataccatatgtccagcggaaacgctgttttaaaaactgttttacggtttccggagcttcggttaccgcaacagctctgttttcgttggctactgtatatccggctttcaagattttcacagtaatatcacaatcttctgccagggtatcggatgaatagcctccggtttcaataaccaccgatcttttaaatgccccgatggctcccggaatcacagtaatggcattgatgtgggcataagccagtctgtcaaaattctgacttgttgtatattctatagcctgccatttggttaaccagtttactctgtttccaactttcacatttcctgcaacagctgctattttttcttcagggtctgaatttaaaaaccttgcaatcagatattttacggcatcctgctgcagtttggtatctgcatcaatacatactacatattccgcatccgtctgtgatatcccgaaattaagagcagtggcttttccaccgtttcttttggtgaaaattttcagtttcgggtgatcaggaaatgctgcttttgctttttcataagtagaatccttacttccgtcgtccaccataataatatcaaagttaggataggtctgtttcagtaaattctgcagggaagacactatattcacttcttcgttataagcagggacaataatggaaactttcggataggattccagaaccggaaactctcccaactttttctctttttttctttctttaaatgcccaatatgccatcagcaaaagtctgatcaagcctaaaacaatgaaaatagtaaataatgctacgaggaaatgactaactccataaataatggtagccagcacaagattcagctgcatgatgtaatatgatttcgttttaggaacttcaggcatcagctcatttctacttttgtgcagaatgctggtaaggttggtaaaatgatacccttgtttctgaagagtcggaatcagaatctttaaagcttttaccgtctcttctctggtatctccgcctgcatcgtgaagaagaatgatatttcctctctgctgtctgatgccggccattacacgttttacaatttcatctgattttattccgggctgccagtcttcaggatctatattttccccgatgtccagataattctgctgtcttgccaaagctaccggaataatctcttccgaagtggtaggctctgagtctgcattgtaaggagctctgaacagaatcgtactgtgtcctgtcacgcactctatcagcagccttgtcagtttcaattcaagtaacgctctttccggacttacttttgccacattttcatgggtaaatgtatgatttccgatttcatgcccttcccgataaattcttttcacaagcggaaggttcttttctgcatttaatcctaccagaaagaatgctgccggaacgtgatatttggacaatacatctaaaacctgcggtgtataggtttcatccggaccgtcatcaaaagtaagcacaagttctttctgaggggcacttccgtatttcttcacttcataagaactcggataggtaacatagttttcgtctgtgataattttctctttcggatcaatttccaacgcgatttttccgtcgtgaggggtattcagaacatccagcacttccccatcaccgatgtaatctaccatggtctgaccttttacattctccaatgcttttaaattgagctttgaaagaccggcaaatgtaaggtctttatcatagaagttccacaccctgctgtcttcacttcctaatctccaaagtgcagttcctgccaaaggatattctgaggagaaacgcattgtattgaaaatagaagctgcatcgttgaaaaatacggtatgggtcagatttttagaatcggtgtaagaataatttaaattaaacgtattgtcattaaaatcaataaccgctttactggcactggctttggtaattgcctgcatgtaagtaacagaagtattatcatccggattggaactccagtcatagccataggctccaaggcccagaataattttttgcggagaggtttgttttacaattttacctgtctgttcttcgatccatttctgagaagaaaccgggccggcatcacttcctgcagaatactcatcataagccatcagcacaaagtaatccacataaggactcagtcttggaatattgtaatcatcattatccgtcataatatccatagtaaccaacagctgattctttttgaaggtttccgaaagttctttcataaaagcgatcagattttcatcagaatcaaggttcatatcttcaaagtcaatattgattcccttgaagtgatattttttacattgtcgggtaatattttgaatcagatgggttcttttttgcggatcattaagagcttttgccaatccttctgaacggaattccctgtcgaagttattactcagcattggcatggcagccacccctgttcttttgatcaccttatatccttccggatctacattggttttcagatcacctgttttgggatcaagaaaaaaccattccggaaaaacaagattcacatgtctgatatttcttttcagagacatcagtgactgaggatcccatgctacataaaatgcagaccggattccgcccggaaactgagcccagtttctgttttggtttttgtatctttctgctcttgccttctcaattttatcaagattggtatggattgttttttcagaaataaagtttctgaaacctttatattctttagaaattttattttcctgaaggtagggtttattagcagtaattacagctttataatcttctttaaaaggaattttaggacttctgtccagtgtcatcatcagacccaaagctagcagaagcagtattcctagaaagataaaaacacggcttccccattgtacacttttccagcgtttcttgctgctggtctgaaaaatctgtttggaattttccacgattttgaaatttattgaatggctttcaaaaagtatgaaaaactgtattaaaattaattaaaaaaaaattaaaaaacaatcttttatctagctgtttataagaaggcttaccaaatcctgaatcaccttttgggaaacaaaattcataaagtctactctttccagatggggcatgtataattttgaggttacctcctgatcatgaattctgatcgtgtagtaaactgttccaacatctttaccgtcttctcctttccccggacccgcaacaccagtcgtagaaagggaaatatgagtatcaaataattgctgacagcctttggccatttcctgtgctacatgttcgctaaccacggtaaactgttctacagtatctttggaaacatttaaaattttaatctttttctccgtagcataggcaaccattcctccaaggaaatattttgaactaccggaaactgaggtgatcatttttgccagttctcctcctgtacagctttctgcagtagaaattgtcagatttctttcggtaagcatttctgccaggattttttcaatcttatcctcagatactgcaatgacgtgtccttctaccaaaggaagcaatttctggatttcttcttctgtctgttgtttcagcagctcttcattatcgcctgaagctgtcagacgaagctttacgcgggtaccgaccggaagataagacaacgcaatattttccggaagtgccagttcccagttttcaattttatcagcaagaatactttcaggaattccaaccacagaaacaatcctggtatggatataatgaagcctgaatcttttctgcagataaggaataatctgatcttttataagcggtttcacctcataaggaactcccggaaggctgtagcacaatttcccgtcctgttccatcatcatacatggagccgtaccgtaatggttctgaaaaacgatggatttagtcggaacaaaagcctgttcgcggtttctttcaagaatatctgctcttccgcgacgttccatatagcctttcaaatggttgaatgtcacctcatccaaagcaatttcatcatcgaaatattcagccaatgcttttttggttttatcatcccgggttggcccaagtcctcctgttgtaatgactagatcgccggtttcaaaggcgttatttaatgcatttttaatcgtatcaatttcgtctgagattgtaagaatctgaataacttttattcctatatttttaagttccgaggcaataaaattagaattggtatctaccgtatttccggaaaggatttcatcaccgatagtaatcagaacagctttttccatatgcttttttgttgcaaaaaattctatgcaaatgacggaaaaatctctggtcacagcaatataaattgattttttctatttttgacgaaattatctaaaactacaataagaattatgtctaaatatgatgacgcttcatggcattatggtggtgactttccggaaggacttcctcagaaaaacagagcaacacatacgggaatgttcctgaactggtgtattcacaataaccttatttctgatgaactgaaagaagatgcggcagaggtaatagaaagagtaaaacgaagagaaatgactggagctgagtttgtcatggaatactgtgatggtaaattttctgaatatgacctgaatgaactcggaaatctttttgcaaaggattattatgcagatgataccgtttttggaaacaggtacagctcatttgctgatgattacgttaatatttttgatgctaaagcagaagaaaatgactatgaatatgaaactttctatcatattgaggatacctacgaaaactatgatctgatgaaacaggttatagatcaccgttttgaagaatggaaagaatacattaacagttaaaaggcaaaagggttaaaaggtaaaagggtaaaaccgtaaaacaaaatactgatctgcctttgacggttttgccgtttcgcaattttactcttttgcttactgctctttattgattatgcctcacccagatcagttcatcggtattatacccgatcttttttgctttctgaatgaaacgctgacgtatgctttccggaatgctggtggtacgggaaagaatccacagatattttaaactgcttcctgcaacaagagcatactgatagtcttcatcaatatctatgacattgtaacctgcccagattggcttaaaaaatgaaactttgagacgggcttctttcggatctttcacaaatttagcttcaccgatagattcattccatacttttttaacgtaatcatagcctttgtttctgacctgaacagtcccatccggattctcagtatattctgccgtcacattctccatatttttctcgaatctgtaatcaaaacgggctatttcataccatctgccaagatattttttaagattaaaattctttacagcagatgctcctctcggaattcttacagaataggaattaaaaacgataagccccagtgctcctaaggaaacgggaagtataattttatgaataattttcatgacaggaatattttggttgttattatagaacgtcaaaaataatgcctttggtctgttaagatacaataaattctatgaaaatactttcaggaaattatctttaaagctgcctgaaacctcaatttctgtatcatcagagagcattactgttccgcttttatgatatgattttacaaatgttgtattgatgatatgagaacggtgaaccctcacaaaaggattttccagaaggtcatcaaaatgtttcagaaaccggcacaccatcttctttgaaccgtctgtaaggtatacctgagtaaagtttccatctgcctgaagtctcacaatatcttctgtttttaccacatcaaatccctgtaaagttggtaagatcaactgctgcttttcaggtttcaatttcagattttcaagaaggattttattccggttgagttcttcttttttctcaagactttccgccactttattaactgcaaggatcaattcctgaatatcgatgggttttaaaatataataacttgccgatttgtttaaagcctgcaaggaatattgtgaaaaagcggtgatgaaaatggtttcataggaaatttctttggtagcttccagaacatcaaaagcgttcccaaagggcatttctacatccagaaagaccagttgaggctgtttttcggtgattaacggaactgcttctttgatattttcagcttcgccaaggatttccacctgcgggcagtatttggtaagatagcttcgcaaaacttctcttgctatgagttcatcatctacaatgacagcttttattttcattacatcggatattaggtggcagtaatcggtttcaggtgcaaattaggaatatttaaccaaccttacaatttgctgatacgagttctccagccatacttttggtcattttttattgcaagaaagatgcaaaagaattattttagggattaaaattaataaaccacaccaaatcatatgaaatcaaagtttcttattctttgctgcatgagtgtattcagtttttctttttcacagatgaaaatcacagaaagagatgatctcagtaagatcaataaaaactggagacttacaaaaacccattccggaacgtacggaatttcagataaaagtggaaaaattattgttcagccagtgtattccaggattaacaaatttggtgagtatgctgatgatctggcactggtaaaaaacatagcgggaacttatggatttattaaccgttctggtactgaaatcattcctgctcattatgaactggactatctggaaaagaatttttccgtgttaaagaaaaaatacatccaatagaaatcacaaatcaatgtggattaaattacttcagattgatctgaatggttaccataacaccgttgctattttccttatcttttactgagcaggtgatctcttttttgtataaatcattcagcaaatgaattctttccagcgtatttttcattcccctgccctcccgcgttttctggtgctgggttttctgttttttgctttcttcgattcctattccgttgtcttcgataaggattttaagatgtgattcacttttctcaaagcttaattttaaaaatcccttatccgttctgtagcggagtccatgccagacagcgttctcaagaaacggctgtatcagcattcccggaaacagaaggctatgcatattcagattttcatccacttcaatttcgtaatcaaatttatcggcaaaacgtgttttttctaaagcaaggtaattctgaagaaggtcaagttcctgctggaacggaataaaatcttctgtagagttctccatcaccccacgcatcagcttagagaatttggtcagatactgattggcctccagctcattattggtagctataaaatgattaacactatttaaactgttaaaaataaaatgaggattcatctctctgcgcagcgactgaagagctattttcttatttttcgtctgaacttttttcaatgttatgaaaatgaaaataatgagcccggtgagcaaaattaacgcaccaatcagactgtagttaaagacatttttctttctgatcagttcatctttaagctctttttctttttccagctgtgagatgcgctgttctgtatcttcaagaactttattgtcaaccagacttcggtctttggaaacgagattcggaagtttccccaaaaagtctctatacagctgaactgaagcatccacatttcctgagattgcataaaggctgtccagtttttttacacttctctgcgcttccagcgtatgacctttatccagagcaatcacatacgcatttttcagaagacctactgcttccttcggatcatttttcttaatatagatatctgccagttcctggatctgattgactttttcctgcgagttttcctttacgaaatcttctttcagcactttctttttggcttcaatagctttttcaaagtttttgttttccacgtataggtcagctaatttctggttgatggccaatgcctgctgaggagcttctctcttcgaaattttataggctgtgttcagattttcttcagcactggaaacatctttctgtttcaggttaacatcggccagctggctgtagctttctgcaagatctccctgctcactttcttttttgctcagattaatattattctgaatggcttctgttttcagttcgggtgtaggcgaagaaagtcttgccacatcattagaattgactgccttacttctttcactgtagcttacctgtgcagccgtgctgtaattgcttatggctggtgttattttattctgtttctcctgtgactgggctaatcttcgggctgctttctcaatattaggtttgtcattgagtttttcatacagctttttagctttggtataatattcttcacttttcggaaagtttccgctgttaaaaaatgtttcaccaatattataataagaatctgcctgtacaggttcatttttagtatccattgcttttttcagcctctttgtttcaacctgtacttcttctacagcaatactgctgttggtagtggtctgggaagatatggtattgccccaaagcaccagtaaaaagatcataaagagtgtaagcgttttcataaaacaaagatatacatatatatagtatgcccaaaaatcattcaccaagtgaaagctccatttcaccaagtcttccgtttttccgcttctgatccatgtaattttacatcagaattaaaaatttaaaaacaggaaattatgaaattgaaacattttttattaatcggaattttaacccttggaagctttgtaaatgctcaggaagtcaagaaaaatgcaattgaagtaacaggtgttgccgaaatggaagtagagccggatgaaatcatcttcagcatcggaataaaagcagataacaaaaatgatctggcagataatgagaaaaagttatttgatatcctgaaaaacgcaggtgtaaagaacgaagatatcaagttcaaatcaatgtatcagaatatctattctaaaacagctaagttttctaagaactatcagtttaaagccagtacaaaatcaagtctcagcaaaatctttgaagacctgaatcagaaatgggtaagcagcctgaatattgctgaggtgaagaataccaaaattgcagatttcagaaaaacagtaaagatcaacgctttgaaagcagccaaagagaaagcagattatttattggaaagtatgggaaaaaagacaggaaatgctcttgaaattgtagagatagaagattacaccagcgatacgattatgcccgtagcttacagaggaaaagcaagcaatatccagctggaaatggctgatgcgccggtagatttctcttttgacaatattgaaaatatcaaactgaaatacagcattaaaacaaaatacgaaatcctttaaaataacagatttaaaagacagttcctttgggagctgttttttatttcattacttcttcccaacccaccaagtcaaacggcagcttcaccaagtttcctgatttcaagcttcaaatagggataattttacttcaggaatttacaataataaggatttaaagatttccgattacaacaaataaccaataaaaaaacaacaatatgacaacgttaaaaatcttagcacttgcagcgggtacagctttattaagctccgggaaatttccggaaaaccatactgtaaacagtaataccggcaatcatttaacggtacaaaagacgacattgattccggtaacctcaaatgtaaaagacaataaaattcaggttgcccttcttctggatacctccaacagtatggacggattgattgatcaggcaaaatccagactgtggaatattgtgaatacgctgacaactcttaaatataacggcaaggctcccgagattgaaattgccctttacgaatatggcaacgacgaaatccatgatgaaaattatattcgtcaggtcactcctcttacccaggatctggatcttgtttcggaaaagctgttcgccttaagaaccaatggcggcagtgaatattgtggtgctgtgatccgtgacgctgctgccaatctgaactgggacagcaatgataaaagtatgaagctgatttatattgcaggaaatgaagcatttgatcagggaaaaataaattatagagaggttgtttcaaaagcaaaaagtaaaaatatttatatcaacactatcttttgtggaagccgggaagagggaatccagacgttctggcaaaatggagcatcactgggaggttgaaaatatttcaatatcgacagtgacagaaaggtactctatattgaaacaccttatgataccagaatttccgaatgtaatgcaaagctgaatgatacttatatctattacggaaatcatggttcagaatacagacttaagcagattacacaggataaaaatgcagaaatgcagtcagcttccaacctggtggaaagagctgttgccaaatccaaaaagaatgcttacaaaaatgatcactgggatctggtagataaagctgaaaaagatgccggatttattgctacggtaaaagaaagtgaactccctgcagagttgaaaggaaaaagcaaagaagaaattcaaaaaatgattgtgacgaagtctgcagcccgggaaaaaatacagaaagaaatagaggaactttccaaaaaacgccagacttatattgattccgaaatgaaaaaaagaggaacagatgattctgacgatttgggaaaagcaattgaaagttctattcttgaactggcaaaaaagaatgggtatagtttgtagttaaagcgggttgaggcccgcttttatgatattcggcacctcttttaataaagtgctctttaacttataattaatttaacttagattcctacggaatgacacactacctggataaatcattatgtcaattgtgccattccgcaggaatctaaataaacctttataccgggcaggctcaaaagagctgcctggtttttgtcttaaccaccccgtcaaaaattctttgaattttgccacccctccacaggatgggaattgagtactgttattagaatatttgtcctagtgctattatgacaatctatcttccaaacttaaaatatcttgataacgggtgctttttattcttcataaataaagaagccatttccattcctgtcacggaaaaagtaattccgtttcctccgaagcccagcacaaaatatgaatttttaaattttttatgttcactgatataaggtaatccgtcttttgtttctccaaaagtccctgcccatacaaaatcaggatagaagtggtaatccggctttattttctttaatgtttttatgatttttttctcttttatatttaagatagcatcacgtttttctgcattataaaagtcttcatcctcacctcccatcaaaagccttccgtcatcagttgtacgcatatagagatagggatcatcggtattccagaccagtgtactggttatatttttaaacttgcttttatcaatttccgaaacgacagcataagtacttttcagggtaacaaagttctccttcagcaggtttttactttcatagcctatacagtaaataatctttttagctttgatctgatatccgctgtctaccgtaacgagattaaaccctttatgctcgtctacttctaccatttcggtcttatcaaatattttcaaccctttctttacattatgctgaaaaagctcatgtgcaaactgaaaagcatcgatacttgctccttgtttagataatatcccgccgtaagtattttcaaatccgaactgttccaaaatctgatcttcagagagccatttcacttcaaatcctgcattttttctcgcctcaaattcttttttcagccatgctacgtctttctttttggaagcataatacaatgatttcttacgtttgaaaccggcatcagaccgtatgagttttgccagcttttctatcttatcaatagcgtcactacaggcgttatagcttaaaacagcacctttttcaccaatttgttctatcagttcatagagcggaacatctatttcgtactgcagcattgaagtggtggcagaagtacttccattacatatttcccgcttatcaataagaatggtgtcatatccgtcttctatcatctgatgagcgatcaggcttcccgtaataccgcctcctacaataagaacatcacatgattcatttgattttaatgaaggataagatgctaacaatccgttttttaaaagccagaaaggttcatttgatttgagatccatattaatattttacactgaaactaacaacatttataccttttttaacaattttcccacaaattatggtgtaattattgttattcttttaaactgaaccaccataaaatattgattatgataactattattccagaagccccggagaatgttgcggcattcaatgcaacgggagaagtaacaaaagaggattttgaaaaactggtaattccgcgtgtaaaagagaaggtagaacagttcggtgagctgaattatttattgtatttggataccgatctggataattttaccatgggtgcgtggcttgaagatttgctgctgggactgaaaaatcttaccaactggaatcgttcggccattgttactgacaaagaaggaatacgtaattttaccagtatcttcagtgttctgatgccgggagagtttaagtctttccccaaagaaaatttatacaatgccctctattggtgcaaaaacggagatgaagtagaggcataaacttatcttatacaaaagaacctgtttcagagaaacaggttctttttttatcttcagttataataaccgtacgcttattgatcacaggaaacacattctgtaacagtttcctcttcattttgagtctgagatctgtacagatacatatatcttatacttacaaccaaaccaataaaggtcatccccactcctaccagtgaaggataattgaatgaatacccgtattccaaaggaattcctccaagaaaagctcccattgcattcgcaatattaaaaccggcctgcataaaagcggcagccatcatttcacttttcggggcagctttcatcatcataatattgatgggcgatgcaatagacattgataaagcaccgcacataaatgtcagtaccaaagcaatatttttatactctgcaaggaagaaaactcctccaagggaaatcatcatcaggaagatcaggagtacacaggtcttttcaggacctaatttatctgaaacaactcctcccacaagatttcctaccaccatacccgctccggcaagaaccattacataagccatctgactgcttttgattccggcaacaatggtcatcagaggggtaatatagcttaaccatgtaaaaagtcctccaaatccaatggctgtaatagccaataccagccatgactgtttatttttaaggaacttcagttcttccatgaaatgagtattctggttggattccagattcggaagccaaagttttaaaaatagaatggcaaaaagtccaatcactgctacgatcgcaaagtacagtctccaatggaaggtatgtccgatgtaggtaaccagaggaaccattgcgagattggcaaccgtaagcccggtaaacatcatggatatataaaatgcttcttttccttttccagccattcttgaagcaaccactgttcctactccgaagaaagcaccatgaggcagtccggacagaaaacggataactaacatactgttgtatccaggagcaattgcagaaagagcgttaaacagtgtaaaaaggatcataaaggccatcaggacctttttaggtggaaattttacggaatatccgatcagaatgggagctccgatcaccacacccatggcataagcagaaatcaaatgaccggcctgtggtattgtaatctgtagtgtttttgctatatcaggtaacagtcccattacggtaaactccgtagttcctattcccaaaccaccgatagccagtggtattattcttctatcaatcttcattatatctaaatcttttctgaattaatttttttaatcacttgttcatttctgttttgaaagtgcaaaattcgaaagaaattttgaaattcacttctctttgaatgataaaaatttgctccatattaacctttttacttaattttaaattcagaaataatcaaaacagaacaagatgaaaatccagaaagaaattattgaatttgaaaaagggaaatcattcaaattgtttgccccttccctgaaaaactgttttttctggcattatcatccggaaattgagttggtatatgtagaagcagtgaatggcatccggcatgttgggaaaaatatttcaggttttacagacagtgatcttctgctgataggctccaatgttcctcatcttaattttgattacggtattcagactgaatgtaaacagcttgtcgtacagatgcgggaaagctttcttcaggatattattcttcctgttcctgaatttgaaaatatcaaagtgcttttagaacgttcttatctcggattatcattctccggagaaaccaaaaatacagttattgaaaagttgcagatcattaaagataaaaactcttttgagtctttgatgggactaattgaaattttacagattctcgcagattcaacggaagtcaaagagcttaataaagaagataccagaatcaaatggtttctgaatgataaaatcagaatgggaaccatctacgattatattcacgaaaattatgacagaaaacctaatgtgaatgaaattgcagaaattgtgagtctgagcactccggctttctgccgttattttaaaaagcagaccaacatgacatttacagattttgttaacaattacaggatcaatcaggctaaaatatttcttctgaaggatcagtctgtaacagaagtctgttttcaggtaggttttgagagtctttcttattttaataaactattcaagcagcatacaggagaaacaccttctgagtttaagaaaaagcatttcagacctattgagatcaatggaaaaattgcccctattaccagggaaacagtttgtaataagtagattttagaccaccccgtcaaaaattcaaagaatttttaccaccctccaaaggatgggaatgatgacagtggttattgtaaagattgccacattcattagctaatcccagtcacctataatccgctacctcctgctaataaaaaacaaaaaaccgctcattgctgaacggtttatattttaatgaatatgtttttctgcgtggtaagaacttcttacaagaggagagctttcaacgtgtctgaaccctaaacttcttgcaaaatctccgaattcatcaaactcttccggagtaatgaatttttttacaggaagatgttttttagtcggttgcagatattgaccaagtgtaattacatctacattggcatttctgatatcttcaatagtctggaaaacctcatctttggtttcacccaatccaagcattactcctgttttggttcttctttgtccggcttctttcagatatcttaatacttcaaggcttctttcgtattttgcctggattctcacttctctggtaagacgttttactgtttccatattgtgagagatcacttccggcgccacttctacgagtctgtcaaggtgttttgtaataccttggaaatccggaatcagagtttccattgtggttcccggagaaattcttctgacagcatttactgtttctccccaaagaatagaacccatatctttcagatcatcgcggtctacagaagtaagaacggcatgtttgatcttcatcaatttgatggatcttgccactttttcaggttcatcccagttgacatcgagaggttttcctgtttttacaccgcagaatccacagcttctggtacagatatttcctaaaatcatgaaagtagctgtaccttcaccccagcattctcccatattcgggcagcttccgctttggcaaatggtatttaatttatatttatcaaccaatgttctcagctctctgtaattctttccggtaggaagttttacgcggatccattttggtttttgaacggtagtgtcttgaactgaattttccatttctaaaattgaagttcaaagttaaggaatttttaatggaaaccatcaaacggaaatattgatgaaactgatcatccgaaattcatttgtatatttatggctccaaaatattcttatgagaacaatattatttcttttattgatggtatgcggagtattctgttttgctcaggaacagctgcaaccggcaggttctacggtcatcgaaacggtagacggagatcttgatggtgacaaaattcctgaaaaagtaattgtttacaataccaaggatacaacagatatgggaaacatacgtgaaattcagatcctgaaaaaagtgaacggaaaatggacgatcctggaaaaatcaaaaaatgcagtgatggaaagccgtgcaggcggtatgatgggagatccttatggagaaacgaaaatagaaaaaggaattctgatcatttcacagaatggaggaagcagctggaaatgggatgtaacagataaataccgatatcagaacggacattttgagttaataggaacttcttccacttcaggaaggccgggagattactggaaggatattgattttaacctttctacagggcagctgaattattcaaaagaggtagaaaatactgctgaatatggtaagtctttaaaagaaacttatatcaaaaaaggtgtaaaaatcaatcttcaaaacagaaatcaggaaaagcaacaaaaaatagttcttccaaaaacaaaagaagaagtgtatttttaaataaaaaccgtggagtttaagttttggctaaagccaattttgaattttaatttttagcgaacgggctaaagcccgttcctattgaatagaattgacttttctgatatttaattatcatcaaattcattattcttcaacaattcggctaagacttttttagcgcgcattacccgtactttggtattcgccaccgaaatacccagttcttcagcaatttccttgatgcttttttcttcaaaaaatctcagtttgataatatcctggtaattggcatccagggattctatggttttgatgattttcttctgttcttcttcggaaatcagaagttcttccggagattttgcatattgatttttaacctcgtcaaggttttcaacggcatcttcagtgtcacggttcttttttctccagaaatcaattacggtattctgggcaatagtcagcacccaggttttaaactgaaaatgaggatcaaacatatccagtttcgaaagtacttttgaaaaaacattgacagtaatttcatcggcatcattttcgtctttcaccttcttcatcacaaatgagaaaacgtccacccaaaaaatattaatgagtttagtctgggccttctggtctttatctttggccttctggatgagcaggaatagctgttcgtcgttcattactaacaaatatagagtatttggggtgaaaaacaaaggataggaagggtaaagtggtaaaaaggcaaaacagcaaaagggcaaaatagcagattaatcatttattgtataatatttgcattgttccaatatagctacaaaaaatcgcttcacaatttaccattaatcttttttgcatttttgcccttttgctgttttgcttttttccccttaatacttctgaatttattatctttgcatcttaaaattttaaagttaaaaatcaatgaattcctttatagaagaactgaaatggcgtggtctttttgccgatatgatgccaggaaccgatgaacaactgaataaagaggtaactactgcatatattggttttgatcctactgccgattctttacatatcggaagtcttatccagataaaaatcttagctcacttccagcagcatggccataagcctattgctttggtaggaggtgctacgggaatgatcggagatccgtcaggaaaatcagcagagagaaatcttctggatgaggaaacccttttacattatgttgactgtttaaagaaccagctttcaaaattcttaaattttgaaggaaacgagccaaacaaagcagagctggttaacaactacgactggatgaagaatatttctttccttgattttgctaaaaatatcgggaagaatatcactgtcaattatatgatggctaaagattctgtaaagaaaagattctcaggagaaggcggtgcagacggaatgagttttacagaattcacctaccagctcatccagggatatgatttccttcacctgtaccagaataataatgtaaagctgcagatgggaggttctgatcagtggggaaatatcacaacaggaacagaactgatccgtagaaaagctcagggtgaagcatttgcattaacggttcctttgatcacaaaagctgatggttccaaattcggaaagtctgagagcggagaaaactactggctggataaaaagaaaacttctccttacaagttctaccagttctggctgaatgctacggatgaggatgctgaaagattcatcaagttctacactttcctaggaaaagaagaaattgaagctttaattgaagagcacaaaacagctccacacgaaagaaaattacagaaaaaacttgcggaagaagtaacggtttgggtacatggaagagaagaatatgaaaaagcactgaaagcttctgaaattcttttcggacgttctacggctgaagatcttgtaagtcttgatgaggaaactttccttgaagtgtttgacggggttccacaaaaagagattgcaaaagctgatgttctgggagtgaatattattgatcttctttctgaaaagtcaggcttcttgaaatctaagagtgaggcacaaagagagattaaaggaaacgccatctcagtcaacaagcaaaaagtaaatgatacttttacagctaatgaaacagatcttattgatggtaaattcttattgttacaaaagggcaaaaaaagctactttattgtcaaagtaggctaatctgaaagaccatataaaaatcggcgctgagatgaatctcagcgccgatttcatgtcctaaataaatttaatattaaaatgtataacttgcagtagccgacaaatactgtccgctggaagttccttctttcttcagttctccatctacccagatctgaactttcaaagttgcagaagcatccggtccgacagcgtttactccaacggttgcgttgtatgctcccggttctgatgttacctcagggctgctccatgttgttccgctaagacttgttgcagtggtagggttaccatcaattccgtacaccgctacctcaatattactgcctgaagaagcgattgctttaaagaccactttatgacttttccctgctccattcacattatcatcatctttactgcatgacgctgtaaatccaatcagcattgttgctattactgcaatgaatgcgcctcttaacagctgattcatactcatttttttcataatcttttgtttaaattttagttactatattgaatattctatgattcatgatttgatatgtgcaaagctatgagcctcatctacgtctatcaatcctgaaaaacaagtaattttttctacctaaattccggtattttttatgctaatttttttaattaaattgagcgtttaaaaaaatatttttcagaattgatctataatgaagagattacttgtcctgttaagcctgtttttatcttttgcgttacaatcccaacaaatcattccgcttaatgaaaaatcatatatagacagcttacaaaacattacaaaaggaaactaccctgatatttcaaaagcaacggcatctttccttttgtccaattatttccgtaacagtgattctgttttaagtaagcaatacctttccaacggaaaaaccctggctcgaaaccagccttttatttcggccaaatattactattacgaaggacaatataatctggacagaaataagaagaaagctgcagcttcctatcagcaggctatccgctctttatttaaatttaaaaatgaagaatccgattttcttcaggcccttgcctggtacagctacggagtttcacaaaaggataaagagggttatgttcctttggttaaaatcatgcttgaaaagagtatcccgctggttgaaaaatatagaaacagcagaaacctgggctttctgtatactcagcttgcagttatccttacttataatgcccagtttaaaaaggctgaaggttacaataataaagccctggaaattcttgaaaaacaatacccgaattctgcagagttatttttcacctatctcaattctgccaacaatttctgctatcaggctaatggagatcaggctgaaaagtatttgaataaagccgaaaaactcatcagatcatatcctgaatcttcatccaatgcctattattattacagcaaaacccttttgtatattacccggcaaaaaaatgaagaagcgctccctgtaatagaaaaaggaagtttttataccagaaagtacaaccagaaccttctggctcaaatgttttatttcaacaagtttgacattttaaagaaacttaaaagatataaggaggctaagactaccctggaagatgttttaacagaaaagtctctggctattgatctgaataacagaaaaaccttttataagcagctatccctgcttagcgaagaattgggagatactaaagaagcgctgctgtgggaacagaaatattctaaacttaacgatagtttgaataccgaaaatgttaagcttgaaatcaataaactcgaaactaaattcaatactgctgaaaaagaaagaaaaatcgcaaccttaaatgctgagaaaaatcaaaaagatcttgaagtcaacaaaaagaattcttatctgtgtggaatgggacttgtcttattgcttgtgctaagtcttctcatctttttgctggttattttcagaaaaaacaaaaaaataaacgagcaaaaactcaatgatattaagcaaaaggaagaattgtcattaaccaaagccattcttgatggtgaggaaagggaaagagaacgtattgcaagggatcttcatgatggtctgggcggcatgctggctggtgtaaagatcaatttttcaacgtggtcttccagtcatttaaacccggaaaaggatcaggagttttataaaattctcggacagctggacaattctgtaagtgagctccgtcatgtagctagaaatttaatgcctgaatcattgcttaattttggtttggaaacagccataaacgacttgtgtgaattttacagcagaaaaaatctcgacattgactttcaggctattgatattgataaaacattacctttaaatatccagcttaatatttaccggattgtacaggagttattagccaatgccgtaaagcatgccgaagccagcagtattttgcttcaatgctcgcaatccggcgataattttctgatcacaattgaagataacggaaaagggtttgataaaaatatagaaaacactacccaaagtatgggtctccgcaacctgaaaaacagagttaattatctgaaaggaaaaatggaaatcaattccgatgatcagggaacagcaattaatatagaactcaacatccatggagaatgaaaaaataaatattgtcattgtagatgatcatcccattgttatcgaagggctgagaatgatgctgaacagccagcccgtttttaacgtagcaggaagttttgcatctggtagggaaactatctattgtattcagtctgagatggtggatattgttcttctggatattacactccctgatgctaacggaacagaactttgcagagaaataaaaaaaatatctccaaatacctcggtaatcatgttcagcaaccgctcagaaaggagcattattatgcagtctatacaaaacggagcaagtggttatcttcttaaaaacacttctattgatgagcttgtgatatgcatcagaggagcactttcaggcgacattgttttctgtaatgaaaccaaacagatcatcagccgtctttcccagaatgatcttcctgttcccaggctgaccaaaagggaaaaacaaattctacagatggtagcacagggaaaaaccagtaatatgattgctgaagaactgtttttaagtcctcttactgtagatacccatcgtaagaacctgcttcagaaattccatgcaaagaactcaacagaattaatcaaccgggctatgcagcaagggatgattgaagaataaaaaagaccgctttaaaggcggtcttttcatatcatgttaaagtaatttacggttctaagaagctgtaatcaattgaagcaaccaatacacctttacctttcttcttcacggttcttgccacttctccatcaatgtacagagtgattgttaattcagaattatcatccggcattgaagcattggcatcaagattcagctgcgcctggctggagtttacaaagaattctccacttgtccagggtgaatttaccggcgtctgaggagtattgtaaattgtattctgagttgtacccacctgagttacaacgcttataatttctcctccggcagttgttttcacttcaaactgaaccacatgatctttaaactcttcatcatcatcttttttacaagaactgaccacggtgattacagaaaataataaaacgaataaaaaagaaagtctaagtaaactttttgaattgtaaaattgcttcatttctccaaatagattttttaatgtttcaaatataagttttttattaatataaaaataatttttatgaaaattttccaataaagatttccaaataatatcaaatcaataaaaagaaaaatgaccggaaaaattcaaaaatatagaccaacggatcaatcattatacataaatcatcctgcagctgaagtttattgtatgaataataaaagttaagattctggatgtaatttaattatatttgctgtatgaatttagattatctagtaagagagccggaaaatattacatccaatacccctattctttttatgcttcatggctatggcagtaatgagcaggatcttttcagtttcagggagacacttccctccgactggatcattgtcagtttcagagctccgcatgatactcaatttgaaggatattcatggtatgacatcaattttaatgatcctgaaaactttatcaatgtttcccaggcaaaggaatctcttaatgcggttctggaaagtatactgaaaatcatcaatcattacggactgatggaaagcaaagcccatttatgtggattcagtcagggaggtatactatgttatgctttggccttgcaacatcctgaacttttcaaccgtgttgcctgcctgagcagctatcccgaggaaaaaatccttgacggtattgtgaaagacaaaaagaaactggaaggacttcgtttctttatttctcatggtactgatgacgctgtgattccattggaatggggaagaaaggctgcagacctcctttatgatcttagctgttatttctctttcagagaatatatgagcggacatggcgtgaaccagaaaaattatatggatctgatggatttcttttccaaataaagaaaccggatttaaaaataacaacaaaaacagcacttcattgcagtttatataaacattccagcttttggaatgtttttttattatgatacagataaatttgctaaattcagtaaatgaaatttagattgcttttactgggattatttctaagcatttttgtaaatgcccagaactcttttgagttggttaataccaaaaaagcagttattccttttcagtttatcaacaatcttatctttattcctattactgtcaacggtgcagagcttacttttctgctggatacgggagtttcagatgccattctctttagtctggaaaataaggagctcaaacttagcaatgttgaaaaagtcaaattttccggtcttggaggtagtgtaagtattgatggtttaaaatctgagcgtaatataggcaaaataggtgatgagattgtcaatacctccatgtctctctatattatcattgatgaagaatttaatatttcgccacatgtaggaattcctgtcaatggagtaatcggttatcattttttcaaagatcatcctatctatatagattatatatccaaaaaaataacagtgtatgaaaatgcagatcttttaaaaaagaaaatcaaaaggtttgaagaatttccaattacaattgaaaaggataagccttatttatatgccggtgtagaaatgacgaatgaaaaaaaagattcaaaactgctgattgaccttggaaacagtgatgccatatggctttttcctacacttattaaaaatttcgtctataacagacctaatattgatgatttccttggccgtggcttcaacggagatatttatggaaaaagaagccgtattcataatttttaccttggagattttaaattcgaaaagccgcttaccgctatgccggatgaattttctatccagcatgtcaatttagtagaaaacagaaaagggtctgtaggtggagaaattatgcgtcgttttacggttatttttgattatcccaataaaaaactgtatcttaagaaaaacagaaattttgacgatccttttcattttaatatgagcggactggacttcaaacaggatggtttggaatggcaggaagacagattaaaaatcgaaacccaaaaatctgctatggttacaactgaagtgtataaagatgcttttcagtataaattcagtttaaaacctatattttctattacaggagtaagaaaagattccccggcttatgaagcaggtctgaaaaaggacgacaaagttattagcatcaatggagaaagaacagcggatatgacacttgaaaaaatagtagaattaatgaaatccaatgaaggacggaatattactatggtcattcgaagaaaaaatgaagagctgacattccgcttcatgcttgaagacccaattccttatcaagaataaaagtatgaaaactgaagaaactaccttagacagaataagaaccaggccaagatttaaaatgtttactcacctcaccaaggaagagtatgctgaaaatctgaaaaagtatatggaagagcataaagatgaattttccggtaacatcaataaagaagtcgccaccatttgggttacaacaaaggatgacagctattggaaaccacggcttgccttacgtgtagaaattgaagatgagcataccgtaataaggggaatattcggtcccagttctgcggtgtggacattctttatgttcctgtatttttctttttctattttctggatgacttttttcaccatgtattacgtggagaaacaaataaaaagcgccgaatacccgtgggcattgagcgcttcttttgttatgttgttttttattcttcttacttatattgctgcgagattcgggcagcataaaggcaaagaagaaatgcttaagcttcgaaggtttgctgaagaatctactttacagtttgaaaagaaaattaattagactgggactctacaggtttttcattctgaatcggtgtagccattgcttttgctgctttgatagaatccactactttttctctgttgctttgttctttcagcattttcggaacttcaggttccagtagtttagtaagttcttcaacagatatattattggcattaggatcatccagcagatttctccatggctttcttccgccccatttataatctccgaataccattactgcagtaccttttgctttggtagtcgctccgccgggattcagaatccaggtatctgcataagaatacagccattgggcatctttcctcaataatcgtaagcatgaatgcgaagcaggatatccgggaagggtatattcatgccatccgattcctccgatattatgaatattgaagttatagggaagtttccattcggtgctcactgtagaaatagccagcttctttttccagttggcaaaagtaagtcctcttgtagtctgagccgtttttttacccatactggtaggtccccattttacaaggcttccgttggaataaactgcaaaagcctgtattggatatgagaagatgacaaactttttcaccccgcttaatacatcaagctgcattggaaatggtgaatacgccatcagggttgtatctatttttgcaggaactaccaaagtgtcagcattccatttgcttttagaatccaatctgtttaaagctaaaatagcggttcgttcttctacactatatttcttgctgaattctgcatatacagaatcccgcatttttttatcttttggaagaacaaaagcattatagaaaccattttcctgcattacaggaggaacagattctttctttacaacaggaacagagtctttctttacagaatctttttctgcctccattgcgtccgaagcagaaactgtatctttaaaagtatcgcttattttttctatttcttttttacatgaaacaagagaaacagcgaataaaaatgcataaagaaaggattttttcacagatatgtttttcataaataaaatcggccgtttagtttggctacccagtacaaatatcagacctaaaattgaatcataaaagagattgttaaaaataccgtaaaaaaacggtgatttcagacatttgctagaatattattcatctttttgttctctagtacttacccattataatggtccttcttagcaactactctccttctgactgatatttaataatttgttaaagatcttatcctcatattatctataattttggtaaaatatcagttatcatgttatacatcattatggtagttgtactacaggcacttattacccttaccctgcttatgtcccttatcagaaacagggagtctgtgctgaatatgcagcttctttatataggagtggttacattggatatgggatatgaatatttcattattcaaaggtttggctatgaatctgttctgtatgaaattcctggaagtcttcgtgttttcaaaggccttattttcctatatatcacaacctatttaattcatgcaaaatggagagataaactcaagtacctcattgttccgttaacgctggtagttattcatcatgctattgcgatctctgcaaagatgcttgatctttcctgggctgacctggccatcagttcttataaatcttattttgtttactacagttactactggcttgccagtcttattttgtgtatttatttactgacaaaataccggaaaaatattactcatcctgcagcaggtaattttcgttatctggttggttatgtattgctgggcgtactggtgttctgggcagtttacaaactgggctggaatactttgatctatcagaaaatctacagccttctgtttctttttcagttcggatggattttgtacgtttatattgtaacgtaccagcacaagctgcagcagcaaaatataaccagtctttctgttcccagagaaacctatcagtacaaagacctttcaaaaatagattttgaagtggtacaaaatgccattatttccttctatcaggagagtcatgattatctggatgaggagtttactttagaccagctttccggccgtctgaaaataagcaaggcagatttaagcatcacctttaataagcatcttcattccaattttcacgaatacaccaacagacaccgtattcagcactttaagaaaatcttacaggaggatccttcagccagcgtaacagatcttgcttttcaatgtggttttaagtcaaaatctaccttttataaatattttaaaatggagtttaactgccttccttctcagcttgttcattagttacaataatttaatattagcaactcactgatttacaatatggttctccgcgaacttaagagaaatagttgcataaaatttaaatgaactaaaacttttgcaggagccgacatctttgcatcaaactttataaggatgtcacgagaaagactttttttaacaaaagcagcattttttcttcttgggcctttggcctttgcacaaactaccgtccacgggacagtagtagacagccagggaaatcttcccaatgccctggtttatattgaaaacagcggacagaaggttacttccgatactgatggttcctttgttcttaataatgtttatgatggcagttataagcttgttgtagaatataaagggtatgacagtgtttatattcctttcaccgtaacggataaaaaggaagtgaatctcggattgattaaattcggagctaaattcaaagaaaacaatcttcaggaggtaattgtcaacagtgtatacaaagcatcaaaggccagggcgattactatgaaaaaaaattccaacaccattacagaggtactttctgccgatgccatcgggaaactgccggaccgtaatgctgcggatgccgtacagcggatgcagggagtatctattgaaagggatatgggtgaaggacgttttgtagcggtaagaggtacacctatacaatggactgcttctaccctgaatggaaacagaatgccaagtgccagcggtgataatgccaaccgcggagttcagatggacatctttccttcggaacttattcagaatgtacgtctgtctaaggctcttactccggatcttgacggcgatgccattggcggaaatgtggattttatcacgaaaacttcacccaacaaagaaacccttgccatcagtatggcctcgggctacgtcaacatgtccaaatcccctacctacaatacttccgttgtgtatgggaataaaatcactgataagctgaaattcattacctcagcagtgatctgggaacgttctacagctatagatcagatgagaaatatctacaactatgggctgaaagataaaacggcttcttattctattaaccagttacagcttcgtgattatttggcgaaccgcagaactttggggttcaatttaggattggattatgagatagacagcaggaataaattatatgcaaaaggtctgtacagtcaatataaagacggccagtcggtaagggaaacctatttcaattttgacagtaaaaatgtgctgcttcaggcccgccatgcagattatcttactgatttatattctatgcagctgggaggtaaccaccaggtgggacagcgtatgcaggtggattggtccttgtctaaggcgcgttcggagtttaaatttaattctccagacaatcttgatccttatgaaagaggatatcctatagtgaatttcatacaaccaatgacctatggaaatttatctgctgacggaagaaagtatatggcaatggatgcgccggatggtattggggataccggaaaatatactctgccttataaccagcaggccgtctcagcagataagctaagacttaaccagattatcctgagccagaaccgtaacagtgaaacagatctcagagggcaggttgatattaaatataaagttaccaacaattttgagctaaaattcggaacaaaatataacaacaaaaataaaattgtaaacagtaccctgcttgtctggatgcccaaatcatcactgggaattcccggagctccggtcacttatctgaatcagcttgagcgtgaaaattttccttataaaggtggtttcatgaatcctttaggcaatctttataatgctgttatcattgatcagattacaaacggacagattgaccagatgtacaattcttccacacaaaacagtttaggattgatgcaggtgagcagcaaggaaagcaactccaatattaccagctcctacaaaggtactgaaaacgtatgggcagcttacctgatgggaacctggaaaatttccgatcagatccagatattgggaggattcagaaatgaatataatgatgttaccttctggggcaaaaaagtagtttctgataaaaacaataaaacggaagatattaaagacacaaaaacttacaatgtagtcctgccaatggtaaatatgaaatggaatatcagcagtgaccgcattctgagagtggcttatacccgatcttttgcaagacctgatttcaatgacctgaatcccggaactattgtgaatgatattaccaataccatcacccagggaaatacccaacttgatcccacattttcaaataattttgatcttatgtttgagaattatttcggaaaactggatctgataacggccggggtattttataaggatatcaccaatcttatctataaagaccagtctgtggtagatcttgcaggaagaacctatactttcacggcccctaaaaaccttgaaggagcaaagctttttggttttgaattcgggatatccaaacgttttgaaaatctgcccggtttcctgaaaaatattggctttgaaggaaattatacgtacatctcttctaaaatgaatatgccggtctatgaaaacggacagcagacaggaaccatgacgaccactatccctaatcaggcgaagcatattttcaataccattctcttctatgaaacgagtaagctgatgatccgtatagccggaaattataaaggaaactatgtaagtgaaatcagagcggctgcaggtgcagaccattatcagtattttgataaaaactttacagtagatctttccacttcttatagccttacaaagaaagtccgtctttttattgagcttaacaatatcttcaatgaacccaaccgctattatatgggcactaaggaccgcgtagaaaatatttcttactcaggaatacgcggacagctgggattcaatttcaatttttaatcaaaaatttttattcatatgaaaaagtatatatatggagctgcattgtgtatgacagcacttatacaggcacaggataaatgccagaatgtaagaatcaaccagctgcagattttaggaacgcataattcatatgctcagccggctgatcccagagtactggaactggtgactccaatcatcaaagggatgatgcagaaatacagcagtatgatgtctgaggaacaaaaggccaagtttaaagaatatcatccctacggaatggatttgaaagaagggctaaattataatcatcccgatttcacagagcaactcaatgccaatctgagaggtctggaaatagatgtttattatgatccggaaggtaacagattcagccatcctgcaacctatgaaattttaaaaactaaaggagtaaatgatctggctccattgaataccaaaggactggatcagcctggattcaaagtactgcatatggtagatatcgacttcaggacgcactaccctactttaaaagatgcccttattgctcttaaaacatggtctgaccagcatcccggacacacccccgtttttataatgattgaagccaaagactcaggtttcccaattcttgaaaacagtaccaaagttcttccatttgataaaaaagcttatgatgaactggatgaagagattgtaaaatatctgggagaggataagattatcactccaatggaagtgcagggtaatttcaaaacgctgaaagaagctgttacccacaacaactggccaaagcttaatgacagtaagggaaaattcatttttatgctgcttcccggaagcgccggaaccctttcttccaaaaataatccttatctgattgatggctcattaaaggaaagaattatgttccttaacagtgaaccggatgattcttttgcagggttcatattaagagataatgctattgtgagacaaaaagaaatacaggctttggtaaagcaaggttatatggtaagaacaagatccgatattgaaacctacgaagctaaaactaatgatttcacaaggtccaaagcagctttcagcagtggagctcaagtcatttccaccgattttttccgagcgggcaatacctatggtaccccttattttgtacaacctcctcagggaaaagattattttaataatcctttaaattcttcctgtagataatcaatattctgacaaaattcttatgacaaaaaaagtcttctatttctagaagacttttcgcgatccggacgggactcgaacccgcgacctccgccgtgacagggcggcattctaaccagctgaactaccggatcaattaaaaattaatgtttttaactggcgcaaatatatagatttttttaaattttccaaagaaaccgatttcttttctttcaaaactatctgtaaaatacagattttcaaagataaaaatttaagatataactgctattaaatacccttttaccaaattttacttataaatcaagaaagccgattataaaaacacacacaaaatcaacattcttgttacttttcattctaagatgataagtttcttagtactatttaaggatatttttttgttattatcctagaactgaatattctttcttactgggaaatacctctatcataactttttcaattctttctctttcctcatcagataaattagatcctgaaggcagacacaagctattttcgaaaagagtttcggctacttttcctccatagtatggtgcatcttcaaatacaggctgcaaatgcatcggcttccagataggtctggattcaatattgtcttccagaaatgccaaacgtaaatcttcgcgggattttgatgtttttgttgaatctattgtaatgacagataaccaatgattactgtaaaaatcagagtttggctccgaaagtaattcaactccttctatttttttacaaacttcagagtaaaaatcgtgcatttttctgcgcccctctactctttctttcaatacttccatttgcccacgtccaataccagcactgatattactcattctatagttatatccgatatgcgaatgctgataatgtggagcttcatcccttgcctgtgtagaaaggaatacaattttatccttatcttcctgagaatggcataccagagctccacctcctgatgtcgtaattattttattaccattaaatgataaaataccaaagtgcccaaaagtaccacatgcctttcctttatattgagaacctaatgattctgcagcatcctcaattaagggaatgttatattctctggcaattgataaaatttcatccatttttgccggcataccatatagattgacaacaataatagcttttggttttttaccttttgtaattctatcatcaatagcctccttcaaagctacaggacacatgttccatgtatctttttcagaatctataaaaacgggcgtagctcctaaataaacaataggattggcagaagctgagaatgtcatagactgacatattacttcatcaccataaccaacattgcactccactaaagccaaatgtaatgcagcagttcctgaggaaagtgcagcgactttaactttttcatttaggaatttttccaaatccttttcaaagccatcaacatttggtcctaaaggcgctatccaattggcgtcaaacgcttcattaatatactttaattcatttcctcccatatggggggaggacaaccatactcttgatttcataatctaaatttttaaacttctactttttattattttccctggattgcctacaacagtacaaccatccggtatatcactgataataactgcaccggcaccaatagtgcaccatttcccgattgtaattccctgtattacacttgctccgattcctatgtgggttccttcccctacatatacattacctcccaatgccgcatttggagatatgtgtacaaaatcttcaagggtacaatcatgatcaattgatgcatttgtattaatgatacagtgttttcctatttttactaatgcattaatagtaacacctggcatcacaatagttccttcccctatctttactcttttggatacaattgctttaggatgaaaaagcgtaacataattgaacagctctccctgctcaactattcttttccgaaccttattgttccctatagaaataacgacatcaatgtcatgtggcggaatttcgttaagaacaggatagtttaatactttctctttcattaaattttcatcaataaaagcctcaatattataaccgctctcttcagccacttcagccacaaccttaccatgaccacttgctccgtataaatacatgctttgtctacgttttaattaattatttcctttaaaagcttctactgtagcttgatctacctggtttattccttctcttattattaccttttttatagtaagaaggattaccttacaatctactgccaaagacagattatctacgtaccatacgtccagctcaaatttctttgtccaagagattgcatttcttccgttcacctgtgcccaacctgtaatcccgggacgtaccgtatgcctgcgtctctgagtttcgttatataaagacagatattgtggcaacaaagggcgtggtcctataatcgccatatctcctttcaatacattaatcaattgcggaagctcatccagagaagttttccgtatgaaacttcccacagatgttaagcgttctgcatccggcaaataattcccatttgtgtcttttttatcattcatagtcttaaacttaatgatattgaatatcttctcgtttaatcccggtcttgcctgaacaaaaaacggtttaccctgattggcaaagtacaataagatcattacaattataaatacgggggccagtataataagcgctattaacgctatcaaaaaatcaaaaagtcgttttaaaaaaaacttatacacgatattctctttctttaatcaatttgttgtattcgcttaatatagcattccagataactgattgctcaaacctatcttcaatcattgggcgggcattcttttttagtgcttcataataatctctgtctgagatcatttttcccatttctttttgaagcctttcactatcttttaccggaataattactccattctggttttctataataatttcattgcatccgttgatatcagaaacaatactgggcaattccattgctccggcctgcatgactacattagggaatccttcgcgataactaggaaagactaatgcatcggaaatcgcaaaataagggcgcacatctttttgaaatcctacagagatgatatcccggttagtttcaatttcttttaatgtatccggagataatggatccaattcctgttccaatggacctaccagtaataattttgaacgctgctggttttcgtttttatttaaagctgaaaaagcttttatcagttcattaattcccttatctcctaccaaacgtcctacaaagacaaaaacaaaatcccagtcttctatctttaattcttttttcagtagaatcttctgatcttctgaaacttgtccaggagaaaagtaattcagatcaattccatttacatttccgttagcaattacttttaagggctttgacgttattttgtaatcgatcaaatcctttttaacgccatgtccttcaggataaatatgggtagcagacttgcaaagcaaccggtccattcctataagcaacttctgtataacaccttttctggtaggaaaaataagtcctgtaaaggtgtgaatccgtataggaactccggcaattttacctgccagcatagtcaaaaggccagctttgggggtaatagaatgtacaataaccggcttttctttttttaaaaccttatatagccgatagagagaggcaagatctttaacaggactgattcctctttccatgtctacaccgatagtctgtattccttccctttgccttacttcgtcaagcaactgaccttcagaagaaatccctacgatttcatagaattcgcttaggaatttcaattgtcctttcaacaatacgtttaaagacagtggtactgttgatgtccgaataactttcatatcaattaatatagagattgaatatcttttattaatctgtttctactctctgtgaccaatctcatagactgatccagctttgattttatctgatcgtactctgaaatagccttatcaaacattttaatcagcaattccggctgtacatcctgaatctgaacaacataatcatcaagattaaaatctcccatgattcccaaagctttgttacctccgtatcctatagcaatggagggaaccagagaagttaatgagaatataatggaatgaaaacgtgtacctacgaaaaagtagaagttggaatacactgctttcagcacatcgcatgatagattttcattaatccagatcatattcggatcctgaactatatttaacagatccctgattgcgttacggtcatcttcatgggaattaggtccaagagactgattgcacaaagccactttataacctttatccaataggtactttgtaagttttgccacagaatcgatatatttcttgtacaaaacctcaggattggaaagtcccggaaaacgccaaggacgaatcgtaatcccaacaattttatcctctacagacagattatatttctgtaatatttttaatgcttcatcctgactgcctttttcaaggaaaaacccaaggtccatttctacaggaatatttttttcaagtaactgccctaagctttttgcagaaacattttcacgggcatatatcagatccagcttattgaagacagagcgtacctgctgcttcacagttagtcctataaaaggtccgtatgagttaggtaaaaagactacttttttccccaatgctttagctaatctgacgtagaacagaaaataccacatcaggtaaggcgcagttttctctccataggcatgaataaagcctcctccttttacaaaaatagttttcgcatcgtgaaactgtttaacagtctggtaagttttatcatcaaatgatttctttactttctcaagatcgttacatatcttaattaaatatcttgtgtttttaaaatctataccggcatttctgatctgctttaaaagttcaagttttgattcttttatatgctcatcagatttatgctgtcccctgcgggggtgtttcaatatattatccaataatttaaagccatgctcctcagattgtttacatagtaattctctttcttcagcattctcacctgcatccaatatatacacctcatcataaagcccggtatctttggccaatctccagctttcccaaacgagagcctggtcacctttatttaaatctgttactccgggtactattatagcgttcatcctaatttaattttccttgtttaatcctgttcgtattttgctttaccttataattgatatagacattcagcgctataccaaaaggaatggctatgaatgtgtatagcttattgggtgagcccttgaaaaaattccattttttggcaaaaaggctcgatgatatatagtgtattgaatttttcaatattacttttttattgatcccatacttcattttcacttttctgtattccatgaatgagttgggactgtttttatatcttttatagagcccattggacagcccgtcctgctggtactctataatacagtatacttcatctgaaaggagaaatttataatcctgatcaatcagcgtaaatatccagcttacttcatgaaagatttcattttcaaaataaggatatggcaaatactttttataaacctctgtatcaaagatgtatttcttatctccttttattttataatagtctaccagttctgaatatgtagattctttgatatccggtaaatattctcccgccacactaccatcctggtaagcatctaaacctataactcctgcagaattggcttttttattcgttttccagaaattcagtattttttctaccgcatcatatggcatataatcatcagaatctatacaggtaaacaattctgtgtcaatataattcaaagccaatatctgtgctgccagcttgcctttgttcttctgataataatactggatatcaaccttattttcttcaatccatatttcaacttgggcacgtgtattgtcacttgagccatcatccacaataatccatttaaagtctgaggaactttggctgcataaggactcataaagcctgacaagggtttttgccctattgaatgttggtgtaaaaaccgttattgccttcatatgttccctagttttttaaagattttatcaaattcttccacctggtttttcttatcataattatgaacgataagtgctctcccattatctgcgatgaattgatataattttttatcattataaagtttatgaatcgcatcataataatcgtccacatgattgtgtgtagcaatataccctgtaaaattattcaggatatagtctgtaactcctccaacagggttggcaataacaggcattccaaatgccagagcctccataatgacacgtggcaatccttctgtatcagaagggtgtataagaatatcactgttcttaaaaatactgtacggatctttctgattaagaagaatctctatgtggtcatccagcttatattgagtaatatcatttctgattttcttcagaaaattatctgaaaccggtgtatcatacacggctcccatcagaatcattttaaagttgatctggttatcctttaatttcttagctagcgcaatagacagatcctgaccttttgctggtaaaaagcccccacaatgcaagatcactattggatcgcctccttttcttacttctctttcctttttatactgatctactttagttacatcaatagcgtttggaactacaaaaattttctccaagggcgcaagaccacctgtaaaaatagcctgtctggtagactgtgaaacgccgataaaataatcagaattatatttaaacatcagctttttaaggaagccgattgaattatatgcaaaccagcctctggcaaaataagcaatcttgtaatcttttcctttctttaagattgaattagttttgatattattaacaatgaccacatctggtttaaaagtattttgaaatttcttaaactctttctgcaacctgatccaatccaataaaaacaaaatgatatttgtacctattttaaagggattttttgagctgaaaatagcaataggactatcatttttctttaaaatatgtatcggtattctattggcctgtacatcttccacaaattcactgcaacttccccagaaatctacaattgccgaattatgcccctcttcatttagtcgtcttgccaactctatagtacttttacgggcacctccatggatctgaacggcttcaaggaaaattatattcattttatatcactttcattattaatatataataaaaattgagttataagtttttaaagctaactgatcaataaaataattacaatattatctcggcactacgccataatatattactattatttaaataaaaaaaaggattttttttcagatctgtgtgttcaatgatcaaatgtgacaaagtaaatttatctttaaaataatatatttacgcaaacaaataattacaataattatattatggataagtttttcactatatataacaaatatacaaaattttaatatgtcacaaacgtttgaatcaaagttaacatttatttataactctcttaaattatattattttatatcgctgcctttattattcttataatcagacaaaaattgatttacattattattagaacttcttgatacggctgacttattaaagttcatattatctaatatcaggtttacgtcattctttttcccttcatagttcctgataaatgatttaccaggtaaattataattactattacttatttcaatttttcctttaagaggttgtaaataattcaatttattcctagtaatgcttaatcctaatgcaatacctgaactgatatcctggtgattatttattttgattgaaattggcttattagtcccatttaagtttccagttgaaataataattccatgaacagcattattttttgtgataatactatctaataccacattcgttatttcattatttttcgaatttggttcaatatcaattccactttgcggattatgcccactggtattggtaattttagtgttttttacataaatattgatccctgaaattattgaaataccatttcttctgttgtcatctataattccacctttaatagtgatgtcttttggaacagtttgttcctgaccaatatatattccatcaccccaaaattttgaaactgaaggtttgaacaactgaatattattacttgattttattgacactccatttccccattccccttcatttgattgatgattatacttatctcccacaatgtttaagtaaaagatatttacattactaacattgtatatattaatcaacttataagcaggtttattactgcttttcaggataatttttgagtttggctggaataaaatatcctgatttgaacgtaaatccagtcctttatcagaaactagtattggaaaatccgggaagacaagttttgtattttcattaagtgccttttgaataaaatccgtgtagtctgtccctcctttcttatctgcattcttaggcaaataattttcaacattaacagcatttttaaagtattgattttttatatcaataaattctttagtacttgtattttggcctgaacaggcaaaacattgaaatacggcgaaaagtattataattaatttatccatttctttagtatatttttatttgttgctagtgtcagaatataaaataataaaacataggtaagcttggtaagtggaactacaaggttacttctggagatataaatactgaatgaaaaaaataataaatatacagctaccaataaaaaattggtactgctataacctaatacataaacctctaatttcttggttagataaccaaataaaataaaaatgataataactccaaagacgccaaagtcaagataaacgtctgcaacagcactggttcctactccccaccttgcatttggacctaaagacatatatgttaagaatacagatgaagaaaaattggttgcatctatacctaattttgagttcaataaattattcaatccagggataataactgaaaaattttgaaacataaataaaccaaaaaaatgcccgtgtactgctggtactttattaacagccacactaattgtgagaacagaagttgctaattctttggtcattggaagaatagaatccggataatacgtgttttcaattttagaattaattgcagaatccagcgtcacaccagtccttcttatcattccaagtattgtcattaccatggatccgacaataaagattgaaataagtttagtagaagatatttttacatcattcagatatatatatccaaaaaaaagagctaaagaaagataaataatgggacctctatcaccactaaacataattaacagtaagtaggcaacaaaaaaaagtaaactatatccatattgtttcaggtaaggtatgaatttagatttcctgccattattaataataacaaataatattaatgctataaaagaggtctcatataatagcattgagtatcctaaaaaaaatgaggtttttctacctgaaccataagtattagcatttagaaaagacgcattaatctgagaaagaaagaaaacaaaagaaagaacatttattacttttaaggcacgaacatctataaactttcttacatcaactccgtgctttctaataacttttctcgattggaatagactggttccaaataaatagctatttaatgcaatagaagcacataaaagcgttttcaaaatcacagccggtcgtataaataagtaacgattacttggttctaaataacctaatgccagatcaacaaaaggctgaaaagtaacaatcagaaatcctatcaaaaatagaacagaaaatttaattttattgttttttaaattgacattctcatctttatctaaaaaagcaaagcttaacaaagaaattgtgtttaaaacaataaataaccacaaaaaatctttgtcatagtaatcgggatactttttagtaacagaaaagtatatctcgaataataatattaggaaaataattactctattcagcattaaaaaacagttaattaaacttaatctttgattttatttctaaaaccatttctttatttataaaaaataccagacctaaaatcaagtaaataattacaaccgcaatggaacctaagataaaattggtcataccactcagattaaaaatcataatgaatttgcgagcaacaaatcccgacagaccagcgatacaaacaattggtaaaatgtctttcgcctgatttttaaatttatatgatgtaatcttattcacataaatcatattgataatacatccgaataaattggcaataactatagaaaataatagtacatttaaatcaaagctaattgcactaaagattatgatgattccaataattttcttgagcacctcagactgtaaaatagctttaccattgcctgtggattttagtatatttcgacttaccgtatcaataataagccctacagaacttaaacataatatattgagcatttcagccgatttactccactgtttccctaatatcagaaaaaccacttcgtctgaaaattcaaataaaatgataaataaaggaaaagaaattaaaagtattaatttcatcaataaagatgattttttctcaaattctttctgatcagatattttacttagtaaaggaaacacaatactatctcctaatgctctgaatatattaatcgggaaatctactagcttctttgcctgatagtaaaatccagtaactaataaagaataaacttttgctattaatgaagaaaccccttcattaaatatcactattaataatgatgaagcaaaaatcttacttccaaagccataaagttcgccaaatgattttttataaaactctattttcggcttatactttactacattaaaaataaaaatacaaaaaaacagattataacataactgctgggaaattagtgcccaaaccccaaatccgtaaaatgccaaacttactgaaataattactgaaatcagtaaggcggcaatactaattattgtttgttttttaaatttcagatctctgattaagtgtactttctgggttaatgaaaaaccacttattattatatttaatcctacaatccttgttaaatttatcagttcttcatttttataaaatgaagcaataagcggtgcacaaacaaaaagaataatataaagaatacagctacaggctaaattaaaagtaaatatagtattgtaatcttcattggatacatcttttttcttaactaatgcacctcctaaacccgattcaacaatcatctgcgaaaaggaaataaaaatagacaagataccgattaaaccaaaatccgatggtgttaaaagccttgctaaaacaatagtagaaaaaaaataaactccactatatccaaacttctctaaagatacccaaaataaacttgtaaatgtttgcgattttaaaaccttatttatcataataatttgactgcattaaacatagtatctctaaaggttattgattacaaatcatatattttattataatctggaatcacattcttccagtactcccttcacatcataaataattcctccttcattcaggtaattattcaaatttactcccataaattctttgtgggcaaccgtaagaataattgcatcaaatttctcttccggaatttcattgacaaccgaaagattgtactcatgctttacttcttcaggtttagcccatggatcaaaggtagtaacatgtaaagaataatcttcaagagcctgaataacatctacagcttttgtattacgtacatccggacaattttctttaaatgttattcctaagttcaatattttggcaccattaattgagatcttctttttgatcatcgtttttacaagctgtgaagccacatattgtcccatagagtcattaagacggcgtccagctaatataatctccggatgatatccgttctcctgagctttctgggccaggtaatatggatctactccaatacaatgacctcccaccaatcccggtttgaatggtagaaagttccatttggttcctgccgcttccaataccgcatgggtatcaatttctaaaaggttaaaaattttagccagctcattgacaaaagcaatattgatatctctctgtgaattttcaattactttagctgcttctgcaattttaatcgttggagctaaatgagttccggctacaattacagatttatataaggtatctactacttttccgatttccggtgtagaacctgaggtaactttaagaattttctctactgtgtgctccttatctcccggattgattctttccggtgaatatcctgcatagaaatcctgattgaatttgaatcctgaaactttttccagaacaggaatacattcttcttctgtagctcccggatataccgtagattcatagataacaatgtctcctttggatagtaccttacctacagtttctgaagatttgtataaaggagtaagatccggacggttatgtttatcaacaggggtaggaactgtaacgatatagatattggcatccttaatatcattgatgtctgctgaacagtacaatcccttctctccgttctgattaaaagggctctggtgttttaaaaccgctttcagtacgtcgttttccacttccagagtactgtcagtacctgtatttaattcttcaatccttttctgattgatatcgaaacctacaaccggatattttgttgcaaataatcttgctaaaggcagacctacatatcctaatccgataacggcaattttatattgtttttccacaaagaatcgatttaaacttgtttttattttaaattttcccaataccagctgatagcttcttttaatcctttttctatcgtatggcttggcttataacctaataatttttctgctttttcaacagatgccagagagtgaggaatatctcctacacggttcggaccatgaacaactttcacatcaccaatcttctcatcgaattcacttaaatactttttaagataccctacaagatcattcaatgtagtacggtctcctactgctgtattataaacggtatttattgcttcaggattttcagtaagcatcgcaagctcattcatctgaataacattatcaatgtaggtaaagtcacgtgaataatcccctgttccgtttattgtaggagattcatgattgattaactgttttacaaacaaaggaattacagcggcataagctccgtttggatcctgtctgcgaccgaaaacattaaaatatcttaagccaatacatttcataccgtaagtttttccaaatacatcagcatataattcattgacatatttagtgatggcataaggtgataatggccttcctatcacatcctctactttaggtaatgattcagaatctccgtaagtagaagatgatgcagcatatacaaaacgttttacattagcatcacgggctgcaaccagcatgttcaaaaatcctgatacatttacatcgttacttgtaattgggtccttaatagatcttggaactgaaccaagtgctgcctggtgcagaatataatccacattttctacagcctccttacaaacttccaaatcacggatatccccttcaatgagtttatagttaggattttcaaggaaaggttcaatattatgacggtgccctgttgcaaaattatctaagcacaccacataatagcctttgtttaaaaagtactccgttaagttagagccaataaagcctgctccacctgtaattaaaattttattcatttttatgatttgaaaattttactccaccaacttttcttggcctttgtctggctgtaaccataaccatagctatagttgtatccatatccacctgctcgtttcgaaacatcattaattacaaaggatacattggaaagttttgaatctcttaccagatcatttgcaaaatcaatcaggatattttttgatactcccgatcttactacatacaatgttgcatctgcggtatctgcaatacttaatgtgtctgaaacaagcatcaatggtgcagagtcaataataatataagtatattgagaagacatctgctcaataagcttctggtaacgtccgttggaaagtagttcctgaggatttggaggaatagctcctgcatagataacatcacatgaaggattggtcgttgaagtatggataagctcctcaacctttactgattcatcatataaaaactcagtaagaccttttcttttaacaggttcgttatcatacctctgaatctgaggattcctgatatcagatccaatcagaagtgcccttgcatttttattagcgatggtaagtgcgagattcacagataccagggtttttccttctcctttcacggaagaagtaaccataataactttagctgaatcctttaccggtaatacaaattttaaattggaaacaagaaccctgaatgcttctgccaattctgaaaaatcgtttttctgtaccaaatgattttcagaatcagtaagtgaaggaatatccaccaatacaccaagacctgaacgttccttaatatcctccctactgtagattttatcatccagcaggaatagcagatagaaaatagcaaatggaattaatattcccaggaataaagctgcaggaagaataatttcttttttaggagataccggtaaatcttctgtgaatgcagggtttacaatttttgcttttggaacatctacagaaagattaattgcattttcctctcttttttgaagaagaaataaaaataattgctctttaaggttttgctggcgttctattcctctatatactttagactgcccgggaaccttttcaatcatattattattcgtattgatctggttctggagctgagaaataccagtctgaactgtttgcttctgttcacggatattatcacggataacttcctttaaagaagcgatttccttgttcatttctataacagcagggttttcgttggtagcctgtttaagggttttatttctactgataaccaatgaattgtattgagaaatagattgttcaagtgaaggattcaaaccaaggttggatggcataagctggttattgcctttcgaagcttctcctgaaagtgagttcaaaagatcaagctgagcctgctgctgaagaagaagcttggtgttgtcacttgtattctgtagtgccagttcagcctgtgcctgaaggtcgacaatacggttacggttctgaaaatcctctttctgattttctactcctgaaagatctttcgtaattacttccagccttttatcaatgaatacctgtgtattctgagcctgtagatttttatctctttgcccatctaaattatactgcttagttacttcattaaggatggcttcagacttttcaggaagagagcctattagactaatatccattagcatcgctttctcatccggcaaattaacttggattgttttttccagcttttttaccttttcaataggatttgaaaagacaattttgtaatccgacttcacattataacgcggatttttttgaaatagcactgtcccgaaatctaacagtacaggagtgttaaattttcccttaacaacattctttttcttttcattatgaatgttaaactcgtctccttttatatctgttaatgtataagcagctgaaacaattttttctttcgtatagcttaatatctttgcagtaataggagctttactaaatagctgcgaatctttaatttctcctgcactataatactcaacattcaggttaagattcttcacaacctgcatcaatataggacgcgaattcactacagcagcctcacttttcagttcatcagcattccctaaaccaattccgagattatcaagatctgaaagggctgaagaaaggtcattttgttttttatcaaatttaagggtagtcttcgtctgatacttaggaacactatacctaagataaataaaagcaagcgctacacagagtataatggaggctataaaccaaggccatttatacaaatattggaaaatggttttctttaaatttaatttatcctccttaggttgaagttctatctgctgcatattttatcttcgtgttaaagcaataataagggtaccagctgtcagtaaagcaccaatgatctggaatgtaagagctctgttaggattcgagttagcctgaacttgtttatttttgtctggctgtacatataatatgtcattctgtttcatataatagtacggcgaacttacaatatcagatctcgtaaggtcaacattaacaatctgatcggttccatcctctcctgtacggataagtttcacattagtacgatctccgaaatccgtcatatctcctgcaagtccaagcgcctggaaaatattgattttctgagaaacactttctttctgccccggttcctttacttcacctaaaatacttacattgaaatttttaagcgtaatagtcaccaatggatctgttagatattttttaaggcgtgattccagctcctgttttagttgtacctgtgtcattcctttagtatatacatttcctaaaaccggaaaagagatataaccttcttcattcacaaggtattcacttggttgtacatattggttaattcctgtagtgctttcgctccctactttatttacagtattaagattaaaaggttttacagcaatttcatcaagcgcagatacaagaatcagaagaacatctccttcctgaatatgtaagccctgaaacttggcttttgcaacctcctcttccatattatgctttgacatatatatcatattctgcttcggtctgcatgataataaagtaaccgataacagtactatatatgcaataatagttttattcatatgttattattcttatctacttgtgttattatttaggtttacctaattgatttcaatcttatttaaatatattgcaacaaaagcttactatatcatttaaatactttaaagcgtactttaaatcctcatttcaaaatcaattctttctctagcaattttcattccgtttaaaaacaaaacggcgaaattattgttttaatattatcttttttatttctataattctctaattttaactatatgcttcattttcagatattctgttattgcatgttaatttaaatggccccaattatttttttatcattcatcagttcaatttcctcaattcaggtatgatctgatcattttcttataacggagattgttctcacaaattttctctttaaaaaattcagctgtcagtttgaaaaaaatatcagaaaagcaatgaaaaatgagaacaagcggaatagcaaactttatcactgaaaatatattttcattttgaagcctaatcaaatcactttgtatatccaggctagaaagggaaaaatataaaaaaaaggaaagaaggaaactaactgaaatactgatgagaaaaacctgccacctggacatataccgtaaaactttgattttaaaaatactccccatatacaataaatctaaaactccctttccattaattcaacaaccagtggcttttattattgaacgaaggtaacaattattattaatatttttaatactatatattaattttatttaaaatatgactgcaatatctgaatgttgtgaattaagtttttgaaaagtttttatttcgagatgctgaaaaacttataaacaaaaaaaatactgcaaaattatattttacagtattttatactactttgatatcgcagctgcgatccggacgggactcgaacccgcgacctccgccgtgacagggcggcattctaaccagctgaactaccggatcaattttttaataagaaattgagaaaacttccgcgatccggacgggactcgaacccgcgacctccgccgtgacagggcggcattctaaccagctgaactaccggatcaattttttaataagaaattgagaaaacttctgcgatccggacgggactcgaacccgcgacctccgccgtgacagggcggcattctaaccagctgaactaccggatcaattttttaataagaaattgagaaaactttctgcgatccggacgggactcgaacccgcgacctccgccgtgacagggcggcattctaaccagctgaactaccggatcattttttaaagaacgtcgtttctttttcgtggttgcaaaattacacctttttttgttatctgcaaattattttagaaaaaaagccttccaatactggaaggcattcattatcaaacttattttttttataagtgagcgcttaatttttcagcgattacctcttttggagctacacctactaatttatctactacttctccgtttttaaagataagaactgtaggaatatttctgataccatactgcatagagatttcctggttgttatccacatctactttcccaactactgctttaccttcaaaatctgatgctacttcttcaatgattggtcctaaagttctgcaaggtccgcaccatactgcccagaagtctactaataccggtttgtctgattttaaaaccgtatcctgaaatgagctgtctgtaatttctaaagccatttttgtttcttttattttattaatattattttcttttaatcctcttatcggatgttcaaaattacgatttttagagcacaagactatctatgctcaacattagttttttctatagtgtaatcttttgaaatttctttcagtgcattgactaatgcatcaatatccgatttggtcgtcatatggctgaaagagatacgcaatggcgtacagtggtccatttcgtcttcagaaagcaccatcatcattaccattgaaggttttgacgctcctgaagagcatgcacttccctgagaaattgcaattcctttcatatccagctgaagtcctatcaatggatttttataaggcagtaatgcacttaaaaccgtataaagactgttttccttttcagcacttcttccattgaactttattccttcaatttctgttgaaagcctttcaattgcataatctttgatatcctgcatatggcgggtatattcctccatatgattcagagaaagctccaatgctttccccagccctacaataccgcaaacattttcagtccccgctctaaggcttctttcctgaggtcctccggtgataattccttttaatcctgttgcctttctgataaatgcaaatccggcaccttttggtccgtgaaacttatgggcactacaggaagcaaagtctacagggatatcagagaaatcaaggttcatatgagccattgtctgcacggtatccgagtggaaaagcgcattatgctctttgcacagttgggcaacttgtttaagattaatgatatttccgatttcattgttggcatgcattaagcttaccagtgtttttttatctgatgcttttaaaagctcttctaatttagcaagatcaatatctcctttttcattcggacggatatagtttacttctactccttttctgcttttcatatccagaatactttcagaaacacatttgtgttccagaggagagctgatgattctttctaccccaaggtgttctaccgaggatttgatgatcatattgttggattcggttccgcaggaagtgaaaatgatttcagccggagttacatgaagatagtctgcaacctgtcttcttacattttcaataaggatttttgcttcctgtccaaagctgtgcgttgaagacgggtttccgaaattcatcttcatagtgccaaccattgcatctataacttcttctgcaagcggagtggttgcggcattatctaaatatactttatccattattattttgaatattttaattctacggagttaaactgataatctgaaggaacagtgaaaataaaccaagggttggaaatcacctgaatttccattccaccggatggcgctccggccggaacttccacatataaaattttattttttacagacacacttttaatctcgtcaatggtatgacttcctgatctgaaagttcccagattgtataaaacaacttttttatttttaggaaattgcgggtatttgatgtaagatccatctccttccgggcctataatgccgaaacttcctttaattgtattacgaaaatctgcttcttccttaataattctaaaacctgcctgtgctgcacctccctgtgactgggatacaataagttctgcgtcatgctgattatcagcactcttttgagaggatgtagctgcacagctcatgaagattactgcacatgcaattgacagacttttcatttttacaattttatctcccaaaattaatgaaaaaattggtaatgtccttcatttgcccatttcaacattggccgatctccggaagtatctccaaatgcaataattttatcgtactttgaatcgttgatttcttctttaattcttatcagtttttctttcccgttacagtttttccctacaaaatttcctgtgaaaactccgttcttaaactctgctcgcgtagaaaccagctccattttaagttcttcagcaaaaggttttacccagatatccaaggaagcggttaccaataaactctgtgtattattcctatcgatattttttataaagtctaatgcattctcccttacgattttaggataatgctgttcaaaaaattgcttagacttctgttcaattttttcctggctttgtccttttaaaatagagccgataaaacttttcttcactttttcagtttcagccagtttcagcttcagcagaataaagagcggtacatgtctcaaaaattgtatacggtattttgtagaatcgtagaatttaagatacataaacattgtatctttatacgtcagggttccgtcaaaatcaaaacaatacaattttttcatttttaaagctttaattttttgaatataaactcagggatattcctgataatcatcataataatactccaaaccggcaaaacatatgccacatttttctcctttttgaaggctttataaatacaggcagctgcctgttttggagtcgctgtcaatttaggattcaaaggcagaccttctgtcatcttagttgccataaacccgggctttattgtaagcacatgaacttttttatcaaaaagataattcctcaaaccactcagataagcggtgaaggcagcttttgcacttccatagataaagttgctctgcctccctctatcacctgctactgatgaaaggccaatgattgttcctgatcttctgctttcaaatttatgggcaaaataattcattacaggaaccagttttgaataattaatgtcaatgatacgttccgtattcctgttatcatacaatccttcttctgttccttcccctaaatatcctacggcacaaaataatacatttgaattgatatgatcaaatctgttgtaatcaatttctttcgtcagatccagatcaatgacttctgcctgctgcagaaactttacatcaatatgtcttgcaaaacgctctgtagtttctttatttgaggtaaaaagataaattttttcaaacttttctccttcctgaagtgctttttccacaaaagcctgtgccacttcggatgtacttcccagaactatcattatgaattattatttatgattcttttgtgctgtaatgacacaaatttagggttttgaatatttttgaggtaacttgttagcgatgatctgctcatactgtctttggtaaggtaaatccttcctccgaactcctgaacaatagcatccagctgatctaccagctttttcaactttgaattaactttaaaatccagcgccaatgtatacccttctacagggaatgagttgtaagcctgcgggttatttttcccaaaaagttttaaaacagctaagaaagatccgtttccgcttttagcaattgtttcaaggattcttttcattccctcttttcctgtttctttagggattaccatctgatactggataaaaccggattttccatagattttattccagtcattgattgcatcgagagggtaaaaaaacgtctcgtaatcgatgaagttttttacttcttttttagattgctttttataatacagccagttgaaaatttttacagtaagcgcattcaatacaaaccccggaaaataaaacggaactgtaggagaaaatttcttcttcagcctcaaaggagtttttgaaaagttctgtggaagctcgtgctggaaagcatgctctcctctcatcaggatacttctgccaatattttttcctttctgaagacagtcaatccatgcaacggtataggtccagttttcactttcgtcaaacagtctgaatatctcatccaggttgtctgcttttatgctttcctggcggatataagcagattctatatttttaagtttaaattttgctgtaagaataattcccgtaagtcccatcccaccaatggttgcccagaatctgtctgaattttcttcccgggaacaggtaataatttcaccattctcggtcataagtttaaattcaatgacatattctgaaaagcatccttccgcgtgatgatttttcccgtgaacatctgaagcaatagcacctcctactgatacaaattttgtcccgggagtaacataaagaaagtatccttgcggaacagctatttccagcacatctgaaagcagcactccggattcacactctattataccgtttaaacggtcaaagctgatgaatttatttaatttcttcgttgaaaatatggattctcccagtgaagcatccccataacatcttccgtttcctcttgcaataatctcgttgtggctgagtacaaattcttttatttttttgaaactgtcctcagatctcatttctttctctactaccgggaaatttccccagttggtaactttctgtgtgaaattaggcttcatttcttaaaataaatttgaattaaaaatgcaactacccaaagtaataaagtaacctgtatataacggtctctgtaaacaatttttgtaggagactccgttctgttgtaaacaagcgtctgctgaaggtatcttaacaatgcgaacactacgaaaattaccgtataaaaaactctttcatgaaatctttcctgaacttccggagacagggtaaacatcaggtagcatactatggccagcgtaatagaaatggataaggcaatatctgcaaactgcacgttatagccatccaatgcctttcttgtttttcctgaaacttgagcattgataagttcacctcttcttttcccgattgccagtaccaacgccaatacaaatgtcaaaagaatcgcccattgcgaaatactgattccagtaatgtaaccacctgccagaacccgtaatacaaatcctatggcaataataaaaatatcaataataggtacatgcttaagcctgaatgtataggcaagattcattaccacataaaatccgatgatggttgcaaacttccaaagtatttcatggaaataaagttgcgtaaagaatacaagaccgatatcagcaatgataaggcctataagaatgcctatcgcttttgattttgaaatagctccgctagccagcggtcttctccttttttcagggtgctttttgtctgcttcaatatcattataatcattcaggatatatacaacactggcagcaagggaaaatattaagaaggcaaaaatgctcttaataagcagatccatattggtaatattacctgaaaaaaacagagggacaaatacaaaaaggtttttcacccattgctccacacggagcagctttaaatatttcttcatttatgttatttcaaatacaaaaataataaattcaaaattgccagcataaaaatacaaaaaaaaccgccggggcggtcttttacgaaaatatttatatattaaattaactattgcccttgtttggcatcattaatcattttttcattagctgtaatagcaaactctactcttctgtttttagctcttccttcttctgtatcattgcttgctacaggcattgcttcaccttcaccttttgtaaacattctgcttgatgcaattcctttccctgttaaatatgcttttacagcatcagctctcctttgagaaagtttaagattgtaatcatctgaacctttgctgtccgtatgaccatagatattgatattagtatccgggttattagccaatacttcagctaatttatcaaggttggtctgtgcaacagaagtaaggtttgaagaatcgaaagcgaagttaacgatactttcattcatggttactttaataccatctcctactctttctacctgagcacccggtaaagtttctttaatatctcttgcctgcttatccattttgttaccgataacgttacctgcaacaccaccgataatacctcccaatactgctcctatggctccgtttcctcctttacctacattgttaccaaggatacctcccagtactgctcctgatgcaacacctactgcggtacctctttgttggtgatttgaattctgaaccgcttcacagctcgtcaataataatgctgatgacaagaaaagggctcctacgtatgtttttgtaaatttcattttttctgatcttttatgttgataaattatttcattcccgttctctggaagttgtaaactacttttacattacttccttcaaaaggaacatcttgctcaagtgaaaactgatctgttgactgattagtcaaggtaaggctgtaacctactgtattttgttttgcttttgtacctgaagcaatttttttaaacataaacgtgttaccgtcttttacttcaaatttgataggctgtgtaattgccgggcaatttccaccaccgtttaaagtataagctcctgtccagttattaggaatcaatctccagtgacttcctacgaagcactgtgcgtctgcaccttcgtcaaaaggtttaattttataccctttatcgtaatctatgctcacaatctgccagtctcctttcattttcaggaaatctgctctttgattttgagatgtagctgctttgttaacagaggaacacgaaactgcaaaaagtgatgttcccaacatccctgcaagtagtaactttttcattttgttgtttattattttgttactataaagttacaaaaaaccgtgccaaaatttaaaataaaaaataaaaagtccgaaaaaattcggactctttatggtttctccttaaatacaggaagataaattattttttaacagccttttttacggatttcgaaggcttggtactgcctgatttcttgccgttatagaaattagtataagcatattccgcagcttttttcagatcgataactccgccagcctgtgattgctctgcaaatccgtttgcagtactcggattgctgcttttcacaagtgcctcaataatctggtacggcttcagctccggcatataagccaataaaacggctgctgctccagctactacaggagaagccatagaagttccctgaaggtatttgtattcattcttaggaacggtagaataaatttcttctccgggagcgaaaacattcaccatttttttattgtaattggagaaatcagctctcagtgcattattcttattggtacttgctcctactacaaggacgttgctcacgaatggtttttcatcagtaacgtttttaaaattagtaggatatgccagatgctctgcgacatcctcattttcattacctgctgcctttactaaaagcacacctttgtcttctgcatatttaaaagcatcccaaactacatttttacctggtgaaacaggcttaccaaagctcatatttaagactttagcaccgttatccactgcatatctgatagcattggcaacatctttatctctttcgtctccattcggtacggttcttacagacatgatcttggctacttttgaagcaacaccgtactggacttcttttccctgcggaagtcctgcgataattcctgcaacgtgagtcccgtgttccgcatccggtccttcgtaatggttattaccataaattttttcagaatagtcgtcatagttatctcctacaatttcctttctcggatcatatgaaaggtcatattgttttgcagcaggagcaaagtgatcaatagcgtccttcatttcctccttcatctttttttcaaactctgcagctgattttcctttgaattccgggctttgcgaaatctgacctaagaaatccaatgcaatggcatccctttgatctgtaggggctttgatggacgcaatagtttcagcggttacaggcttaccattcaataactttaccatattaggaatcaattcgttcagcatagaataagtcctgaagttctgctgcgcctcaacacttttcttattaaacatgtctttggccttcatatacatatcaaactcatccttcatcttagcctggttggctttattctttgcagaatcatctccttcgaagataggcttatatttggcaacaacccttgttacttccatattatcgatatcaatatcaccgtttttacctcctatgaagttccatccgtgtacatcatcaatgtatccgtttccatcgtcatctttaccgtttcccgggacttcattagggttggaccataggttttttaccaatccggggtggtctacctgcactccactgtccagtactcccaccactacggttttaggcttcagccctttagattccaagtatttataagcatttgctgtatttattccatatacttttgaagttgcaaaatctttatgataccatgtcatcagatctttatcttcgttgggatcaatacttttagctttagactcctgtgcaaaagagaaactaaaacctgctaaaaaaactgcagctaataatacctttttcatatgttgatatttaatttttaaagagatacgccaatcgccattatcatttgttttacatctgaaagtttatcaacagcgactgtaacctaatattgttgttttatatttttaatatacaccagtgattccgggcctttattacaaatcaggtcaagaaccgacaggtcttccaaaaatccgaatttatcagaaaacgtctggtaatattcttccatctgaaattctgaaggaagttttgccgaaaacttttccctgaaattgatgctttcaggatttttgatatattcttcattcaaagagtgtgccttttccgttttcagtatctgttggatgacttctatccctttaaggttaaaatcaagaaggaacttttctttaaggtcaaatatttttctgaatttatcttcgtagtactcaaaataaggggagctctggtacgctgttttgatagatttccagtgaagtgttctccagtcttcgcggtaagagatttcaatatctttaaattctcttttcccgttatgatggataggaattattaatgacaattttccgttcgcgccgtagatatttgcacggtttctgtaagtctgcttcgggaagttttcaaactgttcaaatacaatttcattctcaggattcaaaaacactgagaaccatgagattgggggcatgtaaaatgccggcaataatacattcgtcatattcataatgcaaaaatgaagtattttttcaaatacttcattctattttaagtttaatttttctattaatcgtcttcagtttttttctttctgaacaatttcatgaaatactcccatccgaagaacagaatcagaatcatagctgcaatccaccagtaagaggttttattagcttctcctgtattggttgctttaaacattctttcccaacggattttgaatggtgcctgataagtagaactgttgtccgcaaatgcaccctgaaggctcatccaagtaaacattggttttccaacgatattttcttcaggaacgaaaccaaagaatctggcatccagtgatgcatctctgttgtccccgatcatcatataataatcctgctgaatggtatattgactggcttcctttccgttgatgaagatttttccgttctttttttccaggctgttatgctcgtactcagaaatgatccactggtacattggaagagtttcctgattgatggtaaccacatctccttttttagggattctaaccgggccataccaatcctgattccaaggtttgttgatcgggaagatagattgggttgtatcaattttagttttcgcttcgtctctgtaatatactgctgcttctcccttaggcgaaatttcttccttcatatcaataacgtgaggaagttctttaatttctttagcaattttatccgttaagccctggaacccataaaggaaacctccattattctgctgtacttcctgaaccggtaaaaatccataagctttatataaagtagggatatccaattgtgcatccgtagttacaatatatctgtgctgtacttcctggtctcccaaaacggtttctggctttccattaacgaaaagtcttccggctctcatttcgaaagtatcacctgctgttgccacacatctttttacataaggatcttttctgtcgatcgctgtatgtacggaatcctgaggatagttgaaaaccaccacatcatttttctgcggcttgttgaattgtaaaattcttgtataaggaagctttacagcatctacgtaagatttcggatcatctttcgggttccctttctgccctgtatccataatggttccctgaaggaaaggtattgctaccggacgcatcggaagtctgtatccgtagctccatttgtttacaaaaaggaagtcacctaccaataatgttctttccattgatcctgttggaattccgaaaggctgggttacaaaaacgtggatgatggtagcaaaaactacagcaaaggtaatagaaccaatgaatgtatctttcttcttatcatttttctcttcatctgtaaggaacaggtcatttgcattttcatcttctaactctacatctttggaatagttgattactgccatgtaaataaacggcagaatcaccgtaagaatctgatctttgaaaagcgttttcccaaactttttcaccagataaaggtggaaaacagacatcatgattggccctactattggaagataggacaggattgcccaccatttcgggtgttttgtctccttcagaatgatgaaataattatagaaagggataaaagcaaataaagggctgtaccccattttcttgaacagtttccaagatgaaatccccatcaatacggatagtatgaggacatatactgtataagttaaaaaataattcataaattttttgtgcctattcttatgatataaatgataaatgatgagtaataaatgataaaagcagtccgctgtttacaattcactattcatcattttctgtcttattggtctgcaatttacagaatttgttacaaattaaagtcccaaaacgtctttcattccgaagtttccttttttatctttaatccattcggcagctactacagctcccaatgcaaaaccgttcctgttgaatgcggtatgcttgatctcgatttcatctacttcacttctgtaatatacactgtgggttcccggaacctcatcttcacgtattgcaaagataccaagctgtttaccttctgtttcttccagcttccaggcatcaaatttcgggttattttgaataatcccctccgcgatggaaattgcagttccactaggcgcatcttttttatggatgtggtgaatttcttccagctggcaagagtattcatctacattcttcatcagatctgcaagcttttcgttcagagcaaaaaataggttgactcccaaactaaaattggaaccgtataagaaagctgtatcattatccacagctaatttttcaatttcagcttttttctcaagccaccctgtagttccgcagatcacaggtattttgttttcaagacaagctttgatgttttcaaaagccacttccggtagtgaaaattcaatcacaacatccggattattaagattttcagcagttggagtttccttcagacgggcaactacttcatgacctctcttctgtgcgatctcatcaatgatcttacccattttaccgtaaccaactaatgctattttcatataatcttttttattttttcctgcattcaatatggttttcctgcagagatgttgttttttaaaatctgtaacttaaactgaatccagtttttggtgcgctataaccatactggtcctgaataaccgatggtttaaaaaccaaatccggatcatgacggctttcataaaggtgtgcatctactacagcgtctacaatattcagaatatagatcaatcctgtaatagcaatggcataatccctttgtcttttggctctgtcctgtgcatttcctaaagctcttttgtctaaccacggatggctgtccacaaattcattaggagttccgttcagttttgccacataatattcacggtattttttatactggttatcattccatacagcaatacctactcctgcccctacagctccccagacaatcggaatcttccaatactttttattataaaactgtcccaatcctggtaaaacagcagaatacaatcctgccctcgtagggttcagttttatggtttttgcagtgggaccattggctttttcaagatcttcaatgatctttgcttctgttttgcctggttttaccacacggggttcttctttcggaggagtttccatccgaacggtatcgataggtttgacttgtgaataggccagtgcagcaatacacaagaaaagtgtgaaaaatattttcttcattatttaatatgggataaaatatattccagctcttcttcatttttgaagtccagaacaattttaccttttttaccatttccagaagctttgatttccacttttacatccaggatgtcagcgatggtcttctgggcttttttataattattggaaagctccacttttgcttttttagcagcaggagactttggattcttcaatgctgcagctgcctgctctgcctgacgaacgtttaatttttctttgataataagttcaaacaacacctgctgatcttcttcgctttcaagacttatgatagctcttccgtgtcctgcagaaatttcaccgcttctgatggcattctgaatatccggatttagtcttaaaagtctgatcgagttggtaatggtacttctgtccttccctactctctggctcagtgtttcctgagtaagcccgatctcttccaaaagcctatgataggtcaaagcaatttcaatagcatcaagatcctctctctggatattttcaacaagagccatctcaagaagctcttggtcatttaccagacggatataggcaggaatcgttgttaaaccggcaattttagttgccctgtaacgtctttccccggaaatgatttcaaacttttcaccgtcttttctcagggtaatcggctgaatcacgcctaagtttttaattgactgtgcaagttcgtttaatgctttttcatcaaaataagttctcggctgcgtcgggttcggatagatatcttcaagcgcaacttctacaatattccctacaaacttatctgctccttcatcagtagcggagttgatcgttgctttggattctgcacttaaaatggcgcccaagccgcgtcccatagctctttttttgtccttcatagatataattgataaatgatgtttgaaaagtgatgacaggcattcactctggccatttattattaatttaattctttattaagttttcattcttcaaaagaacttcttcagctaactgaatatactgaacagctcctttactttccgcatcataattcaggatactttccccgaaacttggtgcttcactcaatcttacgtttctgctgataatggtttcaaaaaccatttccgggaaatgtagatttacttcttccactacctgattggataatctcagacgactatcatacatggtaagaagaagaccttctattccaagatctttattatggatcttctgaacgtttttaacggtgttcaaaagttttccaagcccttctaatgcaaaatactcgcactggatcggaataattacagaatctgctgccgtaagggcatttaccgtgataagacctaaactcggtgcacagtcgatgataatataatcataatcatctcttacactggctaatgcttttttcagcatatactcacggtcttccttgtctaccaattcaatttctgcagctacaaggtcaatgtgcgatggaataatatccaggttcggagttgctgtccttttgatacaaacccttgtatctgcactatgctccagcagattatatgtagaatactgaacatcctcaacacccaatccggatgttgcattcgcctgaggatcagcatcaataattaatattcttttttccaatactcctaatgctgctgccaaatttacagcggtggtagttttaccaacacctcctttttgattagcaatacctatgatttttgccattattagaactttaagattcaaaaatacacttttttctttgctctcggtaagcagggaaaatcaaaattgagttaaaatattgttaataagcaatttaacgataaaaaaaattatccacaaaaaaaattctttgtggataactatttgaaatttacttttacatgttaattatcaaatttcatggagatcggaaatttgaaataacttcttacgtattctccttttttgtttttggctggaatccattttcctttactggaaattgatttaatagttctcattgcctcactgttaaaatcggcgttggttccgttagcttttacccctgagatggttccgtccatttctacaataaaggtaactgtcgtttttactacatcttctgattcaaatcctgaaccgtcgaagctgttcattactttatttctgaaggagtcaattccgccaggatagctggcttctactcccaattctcctgcttcagcaattttatttttgtccaccgggtcagcaattacaggtggaggtgttgtgattacaggtccttgtcctactgttactgttggaacattaggtgtattaggtataaccggatctcctttaaaattgtccttaaaacctgctactgcatcatcaggaacaggatcttttttcacattatcctgagctgtacttgatggtgtaggcactgtactgtcaaaagtctttgtattgggagctgtttcaggttttaccggagtaatttttaccggaggtgcaaccggatcgtcaggaattaatactggcggaggaagtacatatccttcacctgttgtagtttctacaggcttcaatgcagaaattacaaacggcgtaatagatacagccgccattaaacttgctcctataaaaagtgctttggttaatattctatctgattcgtttcttaatacataggcaccatagtctttattgcggtgctcgaacaggacttcgttaaaccgaaattcctggttttggttatgttgtttcatcactactactatttaaactgttaaaaatttgattattagttttattgttcttatcgataagtactgtttcaatatcaaaacatctgccaaaattttatcaaaacaacataatattagaaaattttatgataaagtttaaattttaacatttataaatagaaagtttatgcaagaaataggagttatttcttctaaagtaagtgggggaacaaacttatgacctcttataaaaacaaaaaaagagaccatcacgatagcctctttttatttttatgttgtaagaaatgttagaataattcttttctgatgatgttctgacttctttcaggacctacagaaactaaataaacattgattcctaagtatttttcaataaactcgatgtatttctgagccgtgtcaggaagttcatcatagcttcttgcttttgtaatatcttcgctccaacctggtaaatcctggtagattggttcgtagttgtataatttctcagttgaagaagtgaaataatcgatgatttttccgtcttcagttttgtaatgggttactactttaaggttttcaattcctgtaagaacgtcaagcttagtgatcacaaggttgttgattccgttgatcatacaagcatgctttaaagaaacaaggtctaaccagcctgttcttcttggtcttcctgtagtcgcaccgaattcaccaccgatctgtctgattttttcacccagctcattatctaattcagaagggaaaggtccgtttcctactcttgtacagtaagcttttgctacaccgataagattttgaagtgaagttggcggaactcctgctcctgaacaaacaccacctgtagatggagaagatgaagttacatatggataagttccgaagtcgatatcaagcattaacgcctgtgctccttcgaataaaacgtttttaccgtctctgattgcttcgttcagctctaattcggtatcaacgattctgtcctgaagctgctttccgatgactaaatattcattgtagatttcttcaacatctaaagccggtttcccgtaatatttttcaaaaagagaattctttacttttaagttcttctcgattttatctcttaaaatttctggatttaaaagatctaccattctgatcccgactcttgcaattttatcttcataacaaggtccgattccttttttggtagttccgatctgagttcctccgtgctcctcttcacggtaagtatccaaaaggatgtggtaaggcatgatcacatgcgctcttctgctgataaagatatgatctgttctcaagcccttgctctcgatctgacctacttctttaatgaaagacttagggtttaccactactccgttcgcaatgatacatttccctttgcattgaagaactcctgaaggaagaaggtgtagaacgaatttctcatcccctacataaaccgtgtgaccagcattgtctccaccctggaaacgcactacatagtccgattttgctgataaaacatccgtgatttttcctttgccttcatctccgtactgaagacctacaactacataagttgacatattttacttttgtttttagattcgtgcaaaattacttttaaaaaaaatgacggccaaattatagaggatatttattttaagttggggtgaaaatcatgaggttgaatattatttcatttctatattttcactttcacacctatataaaatggattatatttactataaatttatacaatgaaaattaaaattctgattttacttttaacaatgcctcttttctacgtgaatgctcagaatacagtcaatgattatttaaatatatcaggtcccattaagttgaatcaaaaggaatataagctcgtatggagctcacatcctaatgaaaattatttcaaacaggaatatatcagttcaaatgaaaacatcaatagatacaacagtatggtattgatcgattttgtaaaaggtgatttcaatatcaaggatgttgttgatcaaaaagtagctgaattgcaggaaatgaaaaaaaccaacccggttatcaattatcagatttttgaaaataaggaagagtatattttagattttcttatcagtgaaaattcaaaaaatggcaaagagatactgattgcagaacgaaatatttatcgctacaaaattattagtaatgagaagaataagggcgttcttctttttgcattgagtgaaagaggatatccggaaaatatggattctttctttaataatttaaaaagcaacacttcaaaattaattgaagcggttggaaattataagcacccagatattgaaataaaataatattccaattgtatgaattcatcccaaaaatcaaactatctgttctcaaaaatagaccccaattcccacctcttctacactttattttccccggaaacagcaaaagccaccctgctcattgttcacggtatgcaggaacacagcggaagatatgcagagattgcagaatattttgcagctcatgggattgctgtattgacgtatgatcacttggggcacggaaactcggtaaaggagaaaaaagacattggtttcttccagcttgaaaaaccggatgaaagacttgttgcagacgcggaaatgatggctgatcatcttgcagaacaatacccggatgttccccattttattctgggacattctatgggatcttttataacacgatgtcttcttcaaaaggtaagcagtaagtttgcaggagctgtcattacaggaaccggcggacctttaccgggaatagactttttaagaggttacttatctttagcgacagcaattgcacctcgtcatcgtacttttttgaattctgtttttacaagtgtcaataacaagcattttaaaaaggataaagatttcagtgataccagctggctcagtgtaaatcctgaaaacagaaagaagtttgaacaggatgacctctgcggaattccgtttacccataatgctttttataccttatttactatctataaaaaagctacatcaaggaactgggcttcttccgttccgaaatcatttccatttttatttgtaagcgggcagaatgacccgatcggtgattttggaaaaggcgtaatacatacggtcaacaacttaaaagctgatggttttcagaatgtagacgtaaagatctatccggaaatgcgccatgagattctgaatgaggaaatacgggaagaggtactgaacgggatttataactggattataacaaaatcatgaggctccatattttcggagcttcaggttccggcgttaccactttaggaagagcattgtctgaaaaactcaatattgaatacttcgacagtgatgattttttctggcttaaaactgaaattccttttacagaaaaacagaatcctgaaataaggaacactattgtttcggataaacttcataccattgagaactggattttcggaggttctattattcattggggtgaaaatgtatttccggtatttgacctgattgtatttctctatcttcctcctgaaatcagaatggaaagattgagaaaaagggaatatgaaagatatggtgatgaaattttcactcagccggaaaaagctcaaaaatatcaggaattcatggaatgggctaaagattatgattacaataccgggattgccaccaggactttaaaggctcatctggaatggctgtctgagatgaacactcctttgattgagatttcaggggattatgaactacaacaaaagatggatatggttctggatgcagtcaacaggaaaggagaaaaataaaaagcaaaatcccggttatagtcagccgggatttttatgataagttttggctcctatgtttgcaaaagaataaatttacatacaaagcaaaaggggtgagagaacagttttggctaaataactcaggaagtatattgtgctttagaaatgtcctcacttctttattccttttaga

SEQ ID NO: 24 - DNA, 76839 bp, Chryseobacterium sp.
tggacagattttgaagaaagtagggtaaaaatcaaagaccttcaccctacgcaagctaactcaaggtcgcttttataaatataaatgtataaaaaatatttggaagttaacacagaatctaaagccaatggaattttggttattatttttaaacgggctaaagcccgcctctactgaatatctcattgattctgcacaaatacagaatacaagcattaatccagcgctaattcccggtctatgccaatttcttccagaaaaacttcatcatgggaaatcaccaacaaggttccatgatagtctttgatggaatgggtaaggatttccacgttctgaaggtcaaggttattggtaggttcatcaagaatgatcatgtcaggagctttattgctgatggaaagtccgcagagaagcaaccgtaagcgctctcctccgctcagcatcccgcattttttgtcccaggtatctttcccgaataaaaatctggacagtaatgttttgacttcagattcctgcatggcgctgtcattgaaagtctgtacaaaatcatacagcgttgagtcattatcaatcagagaatattcctgatcaatatagatactgttgaatccggacctgcttatctgtccttccgaaggctctatttttcccagcagaagttttatcagtgtagtttttccggaaccattttctcctttaatcgagatactgtctccactccggatctcaagactaaggttttccttccaaagtttctgttctccataactgaagttgatattttcagcagtaatcaggattttccctgaatgtagaccggaatcattaaaattcactttcatctgatcagaatttcttaccgatgaacgaagatcccttaattcatgtgaaataccgctgattttctccgtatgaaccgattgtaatttcgaagaatttttctctgcattattcctgagagtattcatcataattcttgccactccggatttttcctgtttccccttccctcttgcatcgagcttttgctttcgttctaatgtttcccgttctttttcctttgctttcttcaacgcccgttctttagcatgaatatcattatgcaaagcttcttcttctactgctttctgttctgcgtaaaaatcatagtttcctccataggctgcaattccctgattgcttaattcgaaaatggcatcaacaagattaagtaatgtacggtcatgacttacgatcacaacggttgcatctgttttgtcaataagatcatacaacagctttctcccctccatatccagatgattggtaggctcatccaatataatcatctcaggctgattaatctggattccggcaagaaaaactttggtcttctggcctccgcttaagccttccagtttccgggtaagttcaaaatcgctaagcccccaaagttccagggcatgccggcatcgttcctcaatatcccaatcgtcattgagtgtttcaaaataaatttcatctacctccccgctggtaattttttcgagagcatgtagcttctgatctattttcagacattcggcaatcgtaaaatgattgaaattcccgaacatctggggtacataaaaaacctccccctgaaggctgatattgccacttaaaggatgtatttcacctgcgattattttcagcagggtagattttcccataccgttgcttcccactaaagcagatttggtatgagattgtattgttaagttggtatgattaaatagaagatcccctcccggaaacccaaaggatatattttgcagtaaaatcatgatttctttcttaataaaggttaaacaccgataacatggtggtcatcgtttgatcaaatcggaaagaaattatatcctacatctctgtatttttgggttttgaaagaacaaagatagcacaaataccggattaaacacaaaaagattttaatgaaaaatctaaaatccgtaactttgcctcctactaaaaattttatggaaagcattaaagttcacgacaaaactttcgttccttatttaaaggatgccgaaattcaggagattgtaaaagagacagcgttaagaatttatgaagattacaaggatgaagttcctgttttcattggcgttttaaatggagttattatgttcttctctgatcttttaaaatattacccgggggaatgcgaaattgccttcattcaaatgagttcttatgtaggaactgagtctacagggattgtttatcagaaaatggaactgactaaagatgtgaaagaccgtcacatcattcttgtagaagatatcgttgatacaggaaatacggttgaaagtcttttcaaatattttaaagaaacacaacgtcctaaatctgtaaaactggcaagtttcttactgaaacctgaagtttataaaaaagatttcaaactggattatatcgggaaagaaattccaaacaaatttgtacttggatacggacttgattatgatgagttaggaagaaacctgccgaatctgtatcagctggaagaaggacaaatcaaccattaaagtgctgttggctattagctggtagcttttagcttaaaattatataaagaaataaatttaataataacttaaaaaagctgaaagcaaaatgccaattgccggaagcgaatcaacattatgataaacattgttctgttcggccctccaggaagtggaaaaggaacgcaagcccagaatctgatcgaaaaattcaatttaaaacaggtttcaacaggtgatcttttcagatataacatgaaaaacgacactgaacttggaaaactggctaaatcatacatcgataagggagaattggttccggatcaggtaacaacagatatgctgatcgatgagatcaaaaaacctactgataccaatggttttatctttgacggatatccaagaacgactgctcagacagaagctttggaaaaaatcgttaaagaagtattacatgacgaaatagacatctgtctttcattggtagtagaggataaaattttggtggagagacttctgaaaagaggtgaaaccagcggaagatcagatgacagcaatgtagagatcatcgaaaacagaattaaagaatattataccaaaacagcagaagttgccgagctttataagcagcagggtaaatatgtagaggtaaacggtgttggagaaattgatgaaatttcccaaaaacttttcgctgaggtagagaaaattaaataatcgggaatgagtaagggatacaaaataacgtcccgcaacccgcaacacaaactatatgtctaactttgtagattacgtaaagatccattgtaaaagcggacacgggggtgctggttctgcccaccttcgccgtgaaaagtatattcctaaaggtggtcctgacggtggcgacggaggtcgtggaggtcacatcatcatgaaaggaaatgccaacgaatggactttgcttccccttcgatacacccgtcacgtaaaagctgaacgtggtgaaaacggaggaaaaaaccagcttacgggagctttcggagctgatgtttatattgaagttccggtaggaactattgccaaaaatgaagaaggcgaaattatcggtgaaattttagaagatggacaggaaatcattctgatgcatggtggtaaaggaggtttgggaaatgagcacttcaaatcttctaccaatcagaccccaagatatgcacagccaggtcttccgggagaagagggttatatcgttttcgagcttaaaattttggctgacgtagggctggttggatttccgaatgccggaaaatctacacttctggcatctgtttctgcggcaaaacccaaaattgccaactatgcttttaccacactgactcctaaccttggaattgtagattacagaaattacaaatcatttgtaatggctgatattccggggattattgaaggagcagctgaaggaaaaggcttaggacacagattcctgagacatattgaaagaaactctatcttattgttcttaattccggctgattccgaaaatcatttccaggagtttaaaattcttgagaatgaattaaaagaatacaatcctgaattactggataaagatttcatcatttctgtttcaaaatccgatcttctggatgatgaactgaaaaaagaaattgcagcagaatttcctgagaacagacagccgttgttcttctcgggggttaccggtgaaggtcttatggaactgaaagatgccatctggaaacaattgcacggataaaattgtacagtgagttacttttatagtaactgcatcataaaaaaaacagcctcagatttctctgaggctgtttttatttataaaatggcccttattgaaatcaacttaacagatttatccctttatatttaacataaaaacaaaaaaacattttatcttttggaacaattattgaagtgaccctttgaaattgaaaagctatgaaatatttactaggcctttgtgcattgatctttttattttcctgtaacacttctcagaaagtaaattccagatattctaccattgaatatgaagcgactccatgttttggattctgccctgtttttaaaatgacaattaatccggacagaactgctgtttttgaggcagaacattttaattttaatgataagccttcaaaggatgaattttccaagccacgtgaaggcacttttaaaggaaccatcaaagaagaagattataatcaattaatcagcttgctggatgggcttaatgtaaaaggtttaaatgataaatacggagagcacaatattacggatcttccaacctcatatttaagaattaaatttgctgacggaacttcaaaaaatgtagaagattatgggaaacgcggaagtgagaagctttcggaagtctataagttttttgagaatctaagaaaaaaccagcaatggactaaggtgaaataagccttataaaaatatttaaactatctttgccataataattccttcttctgggaggaattattattttacagaactattaaccattcaaaagaacatgaaaaagaacatttttttcgctctggcatttgttttatcaacaataagtaatgcacaaacaacttccgaatcgatgagctttggggtaaaaggaggatatacattatccagcatgaaattctttaacacacagctcgattcaaaatcttatttctacatcggaatcctggccgagcagccattgtcctctaagtttggtttgcaggccgaagtattatatacccaactgggaggtaaagacgcttatccctggtatgagttggtaggcaatgaagtggtaaacatgggtaacatgcactttaattataaattcaaccagatacaggttcccatttcagtaaaatattatattgtcccagagctttctgcttctgtagggatgaacttaggatttaatatttcatccaaagtaaaaatgaatactgtttttgatgaggctgaaacacacaattacgaatctttaaaaaccttgaatttatttccatttctaggtgcagaatataagattaatcagaagttttttgttgacgccaggtacaatttcaattttatagaaatgaataaaaataatgcggttcctgttaaaataggatttctgcaggctggtgtaggatatagatttaaataaactgcagatatttaacagaaaaaatggcggctcatattcgggctgccatttctgtttttcaataggcaataagtctacaaaagcggaatgagatacttaaaaatatttaaactacctttgcacaatgtaattctttcagactgaaggaatttttatttaaattttaaaataattcatttgaattttacagacttaaacttaatagaacctattgcaaaagcaattcaggagcaaggttacacgactcctactcctatccaggaaagatctattcctgatatattagacggcagagactttttaggctgcgcacagacaggaacaggtaaaacagcggctttttctattcctattctacagaatttatccaaaaataaaattcccaataaacatataaaagcactaatccttactcccaccagagaactggccattcagattgaggaaaacattaatgcttatggtaaatatcttccgttaaagcaacttgttattttcggaggagtaaaacaaggaaatcaggaagctgcattgaaaaaaggagttgatattctggtagcaacaccgggaaggcttttagacttcattgcacagggaatcatcagcctgaaaaaccttgaaatctttgttcttgatgaagcagacagaatgctggacatgggatttgtgcacgatgtaaaaagagtcattaaacttttaccacagagaagacaaactttatttttttcagcaacgatgccgggtgaaattcagaaactggctaactcaattctgaataatcctgtaaaagtagaagtaactccggtttcatctacagcagatactatcaaacaatctgtatattttgtagaaaaagacaataaactgaatctgctttctcatattctgaaaaatgatatttcagactctgttttggtttttgccagaacaaagcacggtgcggataagatttccagaaaattacagaaagacaatatttctgcagaagctatccatggcaataagtctcagaacgcaagacagaatgctttgaataactttaaatccggtaaaacaagagttctggtagcgacggatattgcagccagaggaattgatatcgacgaactgaaattcgtaatcaattttgagctttccgatgtttctgaaacctatgtacaccgaatcggaagaacaggaagggccggagctgaaggcacctccatttcttttgtagacggccttgatcttttaaacttaaagaacacagaaaagctgatcgggaagaaaatccccgtggttaaagaccatcctttccatacggatgatctggttgcacagaagagagattccaataacaaaccagttcctgccgggggtgaaaaacctaaagcaggcaacaataataattcaagatcaggtaaaaaccgtaaaaagccttcaccaacggcttcagtaggatttaaaaaacctaagaataagaatttcaccagaaagaaataaaagacaaacccctttcaatattggaaggggttttatttatcttgtcattaaattgtattacttaaaaagtttctttgcattttcagttgtagtacggtctatttcagaaaagtcttttccataaatattcaccagttttccggctacgagatcaagatatgaactttcgtttctttttcccctgtgaggaaccggagccagatatggagaatcagtttccagaacaattttatctaatggaatttcatgcagaaactgatctatctttccgtttttgaaagtcactactccaccgatgcctaaaataaaattaagatcaatagcatgctgcgcctgttcaagattccccgaaaaacaatggaaaattcctctcagtttcggatgcttttttctttccagtacctcaaaagtttcatcaaaactttctctcgtgtgaatcacgatcggaagatctttttctattgcccaatcgatctgctgttcaaaagctttcacctgaatatccaaagttgttttatcccagtagagatcaattccgatttctcctattgcaggaaaatgcctctgatcgagataatttttcacaatttcaagttctttctcccaggattccggttttacataacatggatgcaaacccatcattgaaaaaatctgtcccggatattccgtttccagctgcaacattttttcatgggattcagagtcaatggcaggaaggtaaaattctgtaattcctttatctaaagctctctggatagcttcttttcggtcttcatcgaattcttctgcgtatagatgtgtatgtgtatcaatcattttatttaaatttcaacagatcttcataaggattttccagtcccagcaataatccgaaagccggttctgtttttatacccttttttttcagttctattattttttgtttaaattcttctcctttttcctgtaatattttgtattcagcaatcatatgaaggtatgcattctgctcagttgtcggtttattctgtccaaaaatctctatgggaaattcatccaccatgaaatttaatgtaatgcatttttcaccatttatgataggatattcaactttcgtttccacgttgtgaggaataaacctgctgaacatcaaatcatccagaaaatcttcttcgaagtctaaatcaacctcaaaaataagatccagatcacttccttctatgtcaatttcaataggaacagttcctgccaaaataggtgaataagcttttaatttttcaaaaatatgatactttgttagaatattataagcttttttctgcctttcatttccgtttttcaaatagtcaatctttgtaaaatcaggcatttagaatattttatgttttactttcctacgctgattttctattctttgatccagcttttctctgaactcaataaattttgggtctttcttatcattggtcttatgctccagggccttgataattttaaaattttctttgataaaatccttggtttcatcagaaaaataagcatttccaaatttctcgaaaatataattaacagcctgcgtactgggatgaatcatatcttctttataaaaacggtaatcccgcagatcatccattaaaatttcataaacgggcagataatggcagtcttcgaacatcgaaatcgattcgtgaattgctgtaatcagtttggatttacttaactggttttctaccattccatccttggtatgccttacaggtgaaactgtaaacaggatctgtactccttctttacagatgtctttaagatccagaatggtctggtaaattgagctggtcagttcctggtgggaaagcagtcttttttcaaaaaacttctgtggaattttgtgacagttggcaaccagtttatttttcggcagaaattcataaataaatgatgacccataggtaatgatgatccagtcggcttcctgaagaaaggcatttcccgcttcaatggcgctgttaattttatctaaggtctgatgaatatagcgggtatcaaaactggtgtggtggtccagagaaatatattcatcattgtaagtaatcagttcctcttcttcataaaatgcagaatcatgtaatctgttgactgcattattgatagaataaggattgaaaatggtcccaaaaggattatttaaagtctgaagctgcccgtcctgcagtaagtctgtcatttcagaggcaaaacatgaacctatcgaaaatattttatcttcaatctcaatctttttacctgatgcggggatatcaacttctgtcctgaatttcatttataagggattaggatttaggtatcaggactcaggccaactaattcctaagccctaattcctataaccttattttaactttctcttctcaacaaataatttgccagttcgataaaaggttttttcttctcttccggtacatctattttctgaagatagctttgtccgatttcattatgcttttcgatcaggcgcaatgccttctcatctacttttgttcttctgaaaatcttttcaactccgtataccttatctacattttcagtttttttggaataccagtaatccagctcttttctttcttcatctgtagcgtgttctcttgccagcagatacagaacggttttcttgttttcataaatatctccggcatgctttttcccgaattgtgcctgatctccgaatacatcaagataatcatccataatctggaaggcaattccaatatgttttccgaaattgaaaatcgctttggcatctttgaagtctgcttttgcaatcaaagctccgatctcaaatgaagaagcactcagaacaccggtcttgtatgtaatcattctgatataatcgtcaaaagtaacatccttctgggtttcaaagttgatatcatactgctgtccttcacataataaaaggcctgtgtgggtaaatattctgatacatgccttgaagatttcaggttcaagatcttcaaaaaatttatacgctttaagcatcagtccgtccccggaaaggattccaacattaagaccatgcagggtatgaatagttggcttatttcttctcaaaggcgcctcatccataatatcgtcatgaatcagcgtaaaattatggaaaaactcgatggccagtgcaggcttaattgcttctttaagatctcctccgaacatctcacatgccataagcaccataatgggacgaagacgttttccaccatgggaaataatataattcatcggctcatatagttccgaaggtttatctttaaaagtatatttcgtgatagcgtccgcaacaatctgctggtatctgtctaaaaattccataaaatcttataatttgaacaaaaatacgatttttcaaggctttataaaacaaaaaactttgcccttttggacaaagtttatatgataatatgagttatatcttaagataagaaagtcaccacaagataggtaattcctgctacaatagctgagattggaattgtcaatacccaagcccaaagaaggcttaccgtaatcccccatctaacagctgaaactctttttgtcaagcctaccccgatgatagaacctgtaattgtatgggttgtagatacaggaataccgaagtggtctgtgatgaataaagtaatagcacctgcagtttctgcacttactccttctaatgaagttactttagtaattttggttcccattgttttgatgattttccaaccaccgctcatggttcctaaaccaatggcaaggaatgaaaccaaaggaacccagatataatgctgagcaaaataatcaaaacgttctgcagaaggaatattcagatactgaacatcctgaagcatgttaacgtgataataaattactgctgcaccaatgatccccattactttctgtgcatcattcaaaccgtgtcccaagctgaataaagctgaagaagccaattgcagccttttgaaagactggtctgctttgtgcgggtttgatcttttataaaggtgtataataatcagtgtaatgataacggagataatcatccctataatcggagccatgaaaatgaacaggaagataggaattactttatcaaacttcaccacactctgatgtgttacctgattgaaagcttctttaatggtgccccatgttccaaggtccggctgggctgctgccacatcatgatagtccatcatgaaagcatgcataagagcagctccaaggaaaccaccgatcagcgtatgtgatgatgatgatgggattccgaaccaccatgtcagcaggttccaggcaatagctgccacaagaccggaaagtataacttcaagggtgataaaattctcgttaactgttttggcaattgtattaccgattttgaattctccaataatataagcagcaatgaagaacgctgcaaagttccaaagcgccgcccaaagtacagcctggaatggagttaaaacttttgtagaaactatagttgcaattgagttggcagcatcatggaaaccattgatataatcgaagataagagccagcgcaataataactatcagtaaaataggaaattccattttttgctatgtattaggcgtatttaatcatgatgttctcaatcgtattggcaacatcttctgctttgtccgttacaacttcaaggtagttcaatacagatgaaactttaataatgttgatggcatcattggtttcaaataattctaccattgaattggaaagcaggtcgtccgcaatattctcaatagagttcaccttaatacaagcttctttcacctgttccatatttttaaaccctttaaggtttttcatcgcattctgaatttcaagacatgctttgtgaatcaataaggagaagtctgaataagccttcatctcaggtgatttataaaggaaaatatattttgtggatgcgtagatataatcagcaatatcatcaagtcctgttgccagcgtgtggatatcctcgcggtcaaaaggtgtaatgaaatttttccctaattctacgaaaatttcgtgtgtaagttcatcattcttgtgttcgaagtcactcattttcttcaacattgaatcatcattaagatcgaaatccttgattcctgtgttgaattcttctgacattgcaactagattttcagttactttttcgaaaagtacaaagaagattttatcttttggttgaaaagcgtggaaaatattaccaattcccattttttagtatttataattcgagtgcaaatttcttaaaaaaggattgtacgtgaaactatataacattaagttttgttaacattcgcttaacaactgattatcaaacaaaaaaaccggcataaatgccggttttatatggttttgaaagagattagtttgctacttcagctctcatatcttttcctttaaatttcatggattgaatattgctcaaaacattgtctttgaacgatttttcaacttcgaagaaagagaatttctctaagatttcaatatcaccgatttcagctcttttcttgctttttccgccagcagtagctttattgataatatctaaaacatcaagtttctttaaatggtcttttttaccaaggttgaagaagaatcttaccatgttttcatctcttcttcttggctttccaccacgctccctgtctcttcctctgtctctgtcgcggccacgatctctgtctctgtcacgtcggtctcttcttgagtaatcatcatctctgctgcttaatttttgctcaacaaggtcatgcttgtctttgtagtataaagcaagatctttcagctggaactgcagaagctggtgtaccagttcttcttttgtaaagttgctcagatccgggattaaactgtcatcaaattcaaaaagatcttcgtgctccgtcaataatttttcgaatacacctcctacctgagctttgataatatcatcccctgtaggaattgttctttcatgaatttcaatttttgttgcagatttaatctgtttcagttttctgctttcttccggcttgatcagagccatagaaataccgtcttttccggctctacctgttcttccgcttctgtgaacgaatacttcaggatcatccggtaaagagaagtgaataacgtgagtcagtgagtttacatctaatcctcttgccgcaacgtctgtcgctacaagaatatcaatgtttttcaatctgaatttcttcattaccgtatctctctgcgcctgagaaaggtctccgtgaagagcatctgctgcatatccgttctgcattaagaaatcagcaacctcctgagtttccattctcgttctgcagaagatgatagaatactggttagggttggcatcgattaatcttttcaatgcttcttttttctggcggtaccctaccacatagtattcatgcgtaatgttcttcttcacttcgttgatagaacctacagaaatacggtgaggttttgtaaggtaatttttggaaattctttccacttctttattcatcgttgcagagaataagaaagtctgttttgtttccggagtttcgcttagaatggtttccaattcatctttgaatcccattgaaagcatttcatcagcttcgtctaatactaaccaatgaatggcagaaaagtctaatgcctttctgttgataagatcaattactcttcccggagttcccacaatgatttgcggtttatccttcaaagatctcatttgctctacaatactacttccaccataaaccgcagtagttttgatgtctttcatgtacttagagtaattctttatgtctttagaaatctgaagacataattcccgtgtcggacaaagcaccaataattggattttgcgactcgtatcgtcaatcatatccaaaatcggaagcgaaaacgctgctgttttgcctgtccctgtctgcgcaagtgcgatcaagtcgcgaatatctgaaagaataaaagggatagtctgtttttggatttctgttgggctttcgtaacccagttcgccaattgccttaaggatatcaggacttaaattggtttccgtaaataaattcattaactattttaaaatttttgcaaagatacaataaatatttgatttgtttttgaataaatttttaaatatgcaaacttaaattcacaatcttttaatgtatttttaatttttggaaaattaaacctaaaaaaacatgctttgagttaaaaacttgctaaacattatttttttttattaaattggattgattttttctgtgttatttatgaattttcaaaaataaagccatgaaaagcaaatttttctttttgatattctcatgcatagccattgaaatatttgctcagacacctcattatccacccgcctggacattggaaaactgtatcgaatatgcaaaagcaaataatatttccattaattctttacggctttcaaaaaattcggccgaacaggatcttctccaggcaaaagaagcaaaatatcccaatttaagcggaactatttcacaaggactttttgccctcaacggaagtaacggacttcatatgaccggtgcacagacacaaagtataggagccaattcatctatgacactttatcatgccaactatatcaaaaacaacgaagcttcaaaaaatctcctggtacagatggctgacctttcagtacaggaagcccagaacagcatcacccttaccattgcacaggcttatctgaatatcctgatgaatcaggaaaacatcatttctcttgaaaatgtactgaaaacaacacaaactcagttaaaacaaggagaccagctatacaaagcaggaagcctttctaaattaaattatcttcagatacaatcacaggttgcccaggatcagtataacctgaccgctgcccaaaacaatcttcggaccaatactgttaatctgaaacaaatcctgcagcttccttcagattatgattttcagatcgtaaaacccgacagcattatggttgacaaccagctgaagcctctgcaggatgtacaaaacctcgcacaagatcaacgtcctgaagtaaaatatggagaactgaacgtagaaaattccaatacaaatctgaaaatggccagagcctccattcagcctacattgagtctgacaggaaatattttcaccaattactctaacggaaacggaaattattttaatcagctgggaaacaatttctacatgcctatcggcttaagccttggcattccgatttacaacaacagaatttataagacacagattgagaaatcaaagattgccattgaacaggccaatcttgacttactgaataccagaacggttcttaaccaacagatagagcaatcttatatcaatcttcagaatgcactgtctcaatatgattctgcctttaagcagatggacatcagtaagcaaagctatgatatcgtcaacgctcaaatgaaaataggaagtattgactatgtgcagcttcaacagcagagattgctttatatacagtctgttcagaattatctgcaggccaaatatactgcagttcttaacaagcagatctacgaattttacgcaggtaaccctataaatctaaagtaaactatgaacacaaagaataaaaaatggttatactgggttgtgggcggcatcattgcaataggtgcagtctggtttttcttcatccgggaaaaagaaataaaaatccagcttgagaccataaaacctgaaatgggagacatatccaattccattactgctacaggaaccattcagcctgtcgatactgttgcggtaggtactcaggtatcaggaattatcaaaaacatttatgtggatttcaattctaccgtaaaaaagggacagttactggctactttagatcctgatctattgaagtttcagtcagaacagatcaaagccaacctgcaaaatgcaaaaagtaatcttgcttacaacgaaatcaatatcaacagacaatctcagttgtacaaagttggagcgatcagcaaagcagattatgataatgccacaaatcagtacaatgcagcaaaagcacaggtaaatgctgtaactgcacagctttctaccgccgataaaaacctgtcattgactaatatctattctccaattgacggaactgttctcaacagaaatgtaagtgagggacagaccgtagcttcaagcttcagcactcctaccctgttcagtattgccaaggatcttaccaaaatgagggtacgggcctcagtagatgaagcagatatcgggaatgtaaaagtgggtcagaaagcaacatttaccgtagatgcttttccggatgaaacttttgacggtgaagtgtccgaagttcgtcttcaccccaccgtttcatcaaatgtagtgaactataccaccatcatcaatgtagataattccagcttaaaactaaaaccgggaatgacagcaaacattacgatttacacacaggttttaaacaatgttatgaaaattcctgtggcagcaaccagcttccggccagacagtcttgtgatcaaaaaatacaaagttaattctccgtttgccaatggtaaaaagcgcgaaaaaggacaatggaaaaaacaggataaaggaaccgaaaataaaagtgaagcagccgtctggattattgctaaagacagtactatttcccggaaaaaaataaaaacaggaatggacaatgataccgaaatacaggtaatatcaggattaaataaaaatgacaatattatcaccggttataaagttctttcaaaaaaaacttccggcggacaggctaaaagcccattcatgcctcaaagaagaggtggcggaaataacagaaacagcggcggcggtggcggcggaccaagatagcttaaattgtaaaggactatcaaactcaaccagattaaccagcaaccagcaaaacaaaaaagccatggcagaaaaaattctggagatcacagatctgaaaagagagttcaggatgggcgaagaagttgttcatgcactgaaaggcgtcacatttaccgtagaaaaaggagaatttgtaaccattatgggaagcagcggatccggaaaatctacccttctaaatattattggctgtcttgacaagccatccggcggcgattatatcctggatggcgttaatattaagaaccttgaccgtgatgagctggctgttctcagaaatcagaaaataggttttgtattccaggcttacaatcttcttccaagaacgactgcaaaagaaaatgtagagctgcctctcctctacaattctaaaatatctaccgaagagcgtcataaaagagctatagatgccttaactgctgtaaaacttgaaagcaggattgatcatctccctaatcaaatgtccggaggacaacaacaaagggtagctattgccagagctttggtaaatgaacctgtaatgattcttgcagatgaagccacaggaaacctggataccagaacctcctatgaaattatggctttaatgcaggatctgcatcagcaggggcgaacaattgtttttgtaacacatgaacccgacattgccacctttagcagcagaacagtgaccctccgcgatgggaaagtgatcaaagacattcagaatgacaatataaagtctgccaaagaggctttggaaaaccttccggtaaatgatgattataaataatatcaaactgaaaatttattaccatgaacttttcaaaccttttcagaattgcatggaaagctcttttacggaataagcttcgtgcatttttaactatgcttggtattattatcggcgttgcttctgtaatcgccatgactgccattggtgaaggttcaaaaaaaagcatcagcgatcagctttcttctatgggatccaatatgatcactatccggccgtccagtaatgtgaatgtttccggaggtgccagaatcggtgcttcaggattacagactctgagacctcaggatgcggacgccatttcaaaaggagcagcagatgtttcttatgtctctcctgcagtgcagactaacggacaatcgatcaacggccctaataactggccaactcaattacagggagtgaatgaagaatattttaacatccgggactggggcatttccgaggggaatcttttcaccaagaaagacgtcacctcatccaataaagtctgtcttttggggcaaactgtttacaacagtttatttcccaatggtgaagatgctgtaggaagtattataaggtttaacaaagttcctatgaaagtcattggaatccttgctccaaaaggatctaatgcattcgggcaggatcaggatgatgtgattattgctccgttcaataccgttcagagaagatttttgggaattacctatgttcagacgatttatgcagcgtcatcgaatgaaaatacatcgcagcaggcgacagaccaggtatctgagatcctgagaaaacagcacaaactgccagccgacggaagcaatgatgatttcagtgtgagaacccaggctgaactgatctccactatgagttctaccagtcagcttctgaccgtacttttatcagcgattgccggtatttctcttgttgtggggggaatcggaattatgaatattatgtatgtatcggtaacggaaagaaccaaagaaattggactgagaatgtctatcggcgccagaggtaaagatattctgtatcaattccttattgaagcgatattgatcagtattaccggcggaattcttggcgtacttttagggatactgtcttcggaactcgttacattttttctttcgtggccaacatttattacagagtcatcaattataatctcttttatcgtctgtgccgtgacgggagtctttttcggatattatcctgctttgaaagcttcaaaacttgatcctattgaagctttaagatatgaatagtttttgtacatttgaatgataggctttcagattcagatttagatttcgaggcttagcaacaacaaaataaacacccaatacaatatgtccgcaagcatttcttccaagacgtttgattttttaaaaaaattaaataaaaacaataaccgcgaatggtttaatgagaataaaaatctctatacggaagctcagcagaatgtagtttcatttttagatgaactaattaaggaaatgtctggttttgatgaagagcttgccaagattgacagtaaaaaagcattattcagaatttacagggacacccgtttctcaaaagacaaatcaccttacaaaaccaatttcggagcttctctgggaatgggtaaaggaaatcagaaaggaggctattacctgcacatggaacccggaaaatcttttctggcaggaggaatttatatgcccgaatcttctgtactgaaagaagtccgtaaagaaatttcgctgtatggggatgatttccttaaaattctcaacaataaagaattcaaaaaacactttcctgaacttgaccaggacgacaaactgaaaaaaattcctcaaggtttcgaaaaagaagatcccatgggagaatatcttaagcttaaaaatttcatcgtgatatattctgtgaaggatgatgaagtgctggataaaaatgctgtgaaaaatatgaccaaaattttcaaactgatgaaacctttcaatgatttcctgaatgctccttttctttgatacctgagttttttgaatccggatccctcaggtcttccaggacaaacgacataattcagcaaattctgctttgcagtacttttggtaaagtttcaaaaataaacggctattttgttactttaaaaactcactaaaattcaaacggttacaaaacatttttttacaatctctactgaaattcaacgtattataattaacattttttaagaaaagttttacatttttatgtatctttgctgttcgccaaaaagcctacaatgtctttataccaaaaaattgcagaaaaactacagtatataagtccgaatttctacaaaaaaagatattttaaaactttaaataatcttagtaaaaataatttttcggagcgtaatgtagaaccggaactggtatggattaaagaatacctttctaaaaatgcagtgatattagacattggtgccaatgtgggaaccttcctgtatcagctggaaaacgcactggatcatgaaaacatttatggttttgagcccaataagaaactttaccgaagactgaaaaggctgtttccggcaatgcatatccttcctctggcactttctgatgaaaacagaattgcagagttcaaagtacctgtcattaatggaaaaacgattgcttcacgcggtactttaaacacttcttataaagaaaaaggggaagagaaaagctatacggagagagtaaaggttatcaagctggacgaatgggctgcactggaacatttcaacagacttgatttcatcaaaatagacgtagaaggaaatgaaataaaaacattgtccggagcgagagaaaccatcagacgatttcagccgactttaatggtcgaaatggaacaaagacaccacgacacccctatctggaatgaaatatccgaagtaatgaactggggatacgaagccaaatacctgaacagaaacagctttatgctggaaaatcttacagaagatattataacacaaaatacaaacgacgaaaaaaataaaactcagtacatcaacaatattatttttatacctaaaaacatttaaaacaactttatgagtgtagtagcgagacaaggcttcaaatattccattatcggttatattggttttttgctgggcaccgtttccgcaatattcatatttccgaatgattttgaattttatggaaagctgcgctacattcttcccaccgcagaaatgctggttccttttgttgtattgggtatctcctattcgaatgtaaagttttttcacaccgtggaaagagatggcaaaaagcagaatatgctgtcactgtcactgcttactgtttttatcaattttcttattttcacagtggtatttttcttacttccttatttttatccgaagttcaggcattctgaggcatggaagatcaaagaaatgattcttccgctgatcttaatcctttcattttgtgctatttttaataaatacacttccaattataagagaattgtagtttccaatattttcgataatctgtttccgaaaatagccaatctcggagcattctgtctttttttctttgctttatcccagaatatcaatgcggcaatatcacaaaaaattgcgtttgctttcttttttggaattttctttttgatgctgttgggctacatttattacaccaataagcttgaaaagattcagctggattttaatacagattattttaagaagaataatttctggaaagagtttttcaattacagtttcttcggatttctagggactttcgggaattacctggccatcaacagttttatgatcggggaatttatgggaatggaagaagtaggaatttactcggttttatatgctcttatttcactgatttctattccacaactgggattgttcaatatttctgctcctatcattaataaaacactggcagacggagatatggtagaactggacagattccataagaaaacatctttaacactgtatttcctgggtgcggttttattttcctgtattatggtagggtttccttacctgacgcaatttatgcccaagaacggaaccatgctcagagaatatgagcctgtggtatggatctggggttctgctgtattaatagaccttgccaccggcttcaatggaaatattatttcactgtcaaaatattacagattcaatattctggttatgcttttactggctgggttaacgatcggactgaattattatttcattaaaaacacggatctcaaactgatcggaattgccttatctacagcgatctcccttacgatctacaatgtggtgaaaatcgttttcaattatattgtctttaaggtttcgcctttgagtattgaaatgatttttgtttccatcatatgtacgctggcaattacagtagccattgttcttccaaactttaacagcaatctgcttaatcttgtttataaacccgcagttgtcttactgttgatttatattggaaatcatttcacaaatatcttccctgttgaagattatctgaatataagatttattaagagtgtgtttaagattaaataatcacttcccagattgaaatagtgagaggaggcgtcggagattcagagtaagctgtataaaaactgctccagttttttctgaatttctttcctgccatatgttttgtaaaaatcaaatgaggtttctgaaagtgcagttagctgatcaataacattttctttctcaggaataataaaatcaagttttgaaggataatttcccggaaaaacagctaactttccgtaagcgacagcatcgccaaggttccccgtcattttagtcacaccataagtttctttcatgctgaaaaattccgtttcctgctgaatcggacaccataaaacatctgctttctgcatccatctttcaaaatcttcagatgaaactctttcagaaaaataagtgatttcaatatttccaggcaatttttcagacaactgtacgagttgttttaattcatgcccagttgcttttccaaggaaaacaaacttataaggtttatcagtcttcagattctgaatagttttaaaaatatagtcataatcccttcttttttgagatactccgccgggaataagtacaatgaaattttcattttttgttttgtcaaaatcccttgtataaaatagcggtagaaactgatacttttctgagattaaagcttcatccaataccaaaagagatccggaagtctgatatacctttgttttgtagaatagcccttctttaaaccatagttttaatctgaaaacaacgtctcctttgaaaacgctttttatcagatcaaattttgatgctttgataaaattaaggttatgggaaatgaccgctgtattatacttttttgttattgctaaaaatgtgttaaaataacggtgaaccgttccaataacaacgaggtcataatctttcccttttaactgatccagaatcatcgagctgtctgataaaaatacaggctcatcactatgattaatctgatctttaattctttttgaaaaataatagtctactgaaaactccagagaacctttcataatatccatgaaagccttggcaatttctgcgtgggtgtctatttctatgtaagctatttttttcacgatgggagttacattcttaagtttcggctaaagccgatggattttttttgattaaatgggttaaagccctatttaatttttccaacaatgattcatgaagccttctacaattcctggatttacacttcttacaacttcagccatttcttcttcagcattttccaacgttgatcatttacagctttctgttcttcttttgtaattttcaattccagtttctttgatctgcagccttcataagacttaacaatgtctaagaaaaaaccgacagacttgcttttcatcgcttcttttgaagcggcaatatatgcaagaaacctgttcagcccaaggaaataaaaatatcttccgtaataatcggcaggacgtattgtgtaatcagctccttttactttgatcagctttacatggagttcagataaaacaacttccttccatcccagattttcaagcaatatggaatcaatattatcccagcccagtgtttcccttaatcctcccatctgcataaaacattctttacgataagccttcatagggcctcttacatgatgcttattggaatttccttcatatacccatttgccgtctttttctatgtacagaagtcctcctaccaaaccatattttgggttattggcaaaagctgtttctacagtttccagataattatccggaagaataatatcggcatcaaatttacagatgatatcaaaatcattcagggactgagtctgaagtccgcttttaaaagcataaacaacttttgagcccggctgatgttctgacttctgaagagtaacggtttcaaaacgggaatccgcttccgtatatttcctgatgacttcaggtgttctgtctgtagaaccgtcattcacgaccaccactttaaaatccttgctgctttgctgctgtaaagaatcaagagtaaaggagaggttgtcttcttcgttatgagcaggaattatgattaaaaacctcacgggaatgataaattgatgaatgatgaatgagtaatgatcaatgataagaacccactaagagcatcaattatcactgatcattaatcgtttataaatttatttgttatgcggtttcagcatgtttttcggatcaaggatctcatccagtttttcctgggaaagaattcctttttccaacacaaggttgtaaacgctttttccggtttccaatgcttcttttgcaatctgtgtagactgtttgtatccgatataaggattcaatgccgttacaattccgatgctgtgttttaccatattcaggcaaacttctttgttggctgtaattccaaccacgcatttctcacgaagggtatccaaagcattacaaaggaaattgatgttttccataatagcatgggaaagtaccggttccattacattcagctgcaattgacctgcctcagcggcaaaagttacggtaagatcatttccgaatactttgaaacaaacctggttcaccacttccggaatcacaggattcactttgccaggcataatagaagatcccggctgcattggtggaaggttaatttcaaaaagacccgctctcggacctgatgaaagcaatcttaaatcgttacagattttagatagtttaacagctaaacgttttgttgcagaagaatagattacataagatcctgtatcaggagtagcttctaccaaatccggtgcagaaacaatcgggaatcctgtaatctgggctaagtttttagcacaaagagtggcataacctaccggagcatttaatcccgttccgatagctgttgctcccatattcacttccacaaaaaggctggcattgttattcagcttggaaatttcttcttcgagagtggcagcataggcttcaaactcctgtcccaaagtcataggaacagcgtcctgaagctgtgtacgtcccattttgatcacatcatgaaactcctgtccttttgcacggaaagccgcaataattttttccagtctttccaccagtccgatattcatctgaagcaatcccattttgatcgctgtaggataagcatcattggtagactgtgaaaggttgatatggtcattaggtgaacagaattcgtattctcccttattttttcctaatttttccaacacgatattggcaatcacttcgttggcattcatgttgatggaagtccctgccccaccctggatcatatctaccggaaactggtcatgatatttcccttctacaatttcatcacacgcttctgctatcttgaaatacaggttttcgtctaaaagccccagttcatagttggtttttgctgctgcttttttaacaaaagccagccctcttataaacttcggatacgaagacaaaagctgtcctgaaattttaaaattgttgatagctcgttgtgtttgaaccccataataagcgtctaaaggcacattaagttcgcccaataaatcactttcttttctgaaattttccattacagatattttactgtttttgatcgtttaaagatagcaaaaacgcatctaaccgatgcgttttaatctgaattattttaccggatatttttgatttaacgcctgcagtattgcccatgtttcggcatccatgattccgtcataattctgtggacggaaatgatactggaatgcctcaattgttttcttggtggcgtcatcccattgtccgttggaatcaagtgcatatccgaatttctgcagtgaagtctgaataaggaagataaagccaggctcattatattttgcggtaatgtctgcctgagcagcttcaagataagtttgcttagctgcttcgtcataccacattccaatctggtattcgtcatacagctttttccatgggaacataggtcccggatcctgctttcttgtaggagcaatatctgaatggccaagcacattggtaggctgaatctgatatcttgttacaatatctttaaccaatgccgctacttttttcacctgatcgtcactaaaaggagcaaatgttcttttacccgtagcatctgtcgtatatcctgtatttacaatttcaataccgatagaagtatcattaaggtttttgtcgtttctccaagcacttactcctgcatgataagagcgtttgttctcatctaccagctggtaaatctcattatctcctgtattatttaccagataatgcgcactcactgcctgctgggtaagaactgtaattgatttgtcgtccggaagtgcggtataatgtaatattaagtaacgctgtctgaagttctgggcaatggccggaaaataggtcttcactactttatatccggctggttttgcagatacaatagaaccataacttgccgtgttatcattttttgttggatctgctatattggtagtaaaaaagtcgaccccatgatcagataccacttttggttttggagcaaccggaggtgttgtctgaactgttggtttcgcctgtgttaccggggttttcggtttgtacgtattttttttcacattttgttgggaagtacatgaaaaaacaaatgtgcttaatccgatgatatataatgtcttacgcatcagtttgatttttggatgatttattacttcaaaaatacacaaaattttcttgaattttatttggtaaataaagaaatctgttctatatttgcactcgcaataacggaacaacgatcattaaaaaataaacaaaaaggagggttgccggagtggttaacggagcagtttgctaaactgtcgacgcgaaagtgtcgcaagggttcgaatcccttaccctccgctcttctatatattcggggcgtagcgtagtccggtcatcgcgcctggtttgggaccaggaggtcgcaggttcgaatcctgccgccccgactttttaatgtgcttattaactaagcgggaatcaacttttaagggtgcgtagctcagctggatagagcatctgccttctaagcagacggtcaaaggttcgaatcctttcgcgctcacaaaaaacctcacaatttttattgtgaggttttttgtttttattaacttcatacaaattgatctgcacgatttattttcatagaaaatcttgaactttttgtttatattagttctatgtgctattgttatatactacattctaaatctttggataaattctatattggacattcctcagagcctttacaggaaaggttaagaaaacatttatcagatcataaaggatatacttcaaaggctaaagattggattgtagtacattttgaaaattttgactcaaaatcctcagtatataaaagggagagagaaattaaggcatggaaaagtaaatccagaattcagaaactcatacaaacgacacacgggatagagcatcccgatttgtaatcgggacggtcaaaggttcgaatcctttcgcgctcacaaaaaacctcacaatttttattgtgaggttttttgtttttattaccttcatacaaattgctctgcacgatttattttcatagaaaatcttgaactttttgtttatattagttctatgtgctattgttatatacttcattctaaatctttggataaattctatgttggacattcctcagagcctttacaggaaaggttaagaaaacatttatcagatcataaaggatatacttcaaaggctaaagattggattgtagtacattttgaaaattttgactcaaaatcctcagcatataaaagggagagagaaattaaggcatggaaaagtaaatccagaattcagaaactcatacaaacgacacacgggatagagcatcccgatttgtaatcgggacggtcaaaggttcgaatcctttcgcgctcacaaaaaacctcacaatttttattgtgaggttttttgtttttatttactctataaaatattcaccatccactgatcaaaacgatttttatattttcccggccgcatgaatcaggatatccggttctttgatcggatttaagctaaaattctctctctttcagaagaaacaatcagtatatttgtaataggacttattgtatttaaatgttgacagatcaatttggaaggagcataaactatctccggcttgctattgtagaccggtgtaatctccgatgtacttactgtatgccggaaaacggtcttagctggatcaagcaaaatgaactcatgactgacgaagaaatgctcagaatctgttcggtatttacagaaatgggggtcgataaaatcaggataacaggaggagaacctttcgtccgtaaaaacagtattgagcttatccaaaatatatcacaattagccggacttactgatctcagcatcaccaccaatggtcttcttaccggacaacatattccacgactaaaagaatacggaataaaatctgtcaatctaagtcttgacacccttgataaagagcggtttttcaaaattacaagaagaaacagctttgataaggtgatgaaaacgttagatagtctcctgcagtatgatataaaagtaaaaatcaacacagtggtgatggaaggggaaaatattgaggacattattcctttagtaatgcttacaaaaaatcttccggtagatgtccgttttattgaggaaatgccttttaacggaagtgaaactgatatttccctaaaatggaatttcacacagatctacagctatatcaaagatcattttcctgaaattcaaaagacaaatgatcctaaaagttcaacatcatacaattataagattcctggctttacaggaagtataggaatcattgcagcttatacccgttcattttgtggagactgcaacagaataagaatcacgccttccggtatcctcagaacctgtttgtatgaaggaaccggtatcaacctgaaggatgaaatccgtatgggaagaacaaatgaagagctgaaaagtatcattaccggcagcatacacaaaaaaccgaaagacggctgggaagctcagaaactgagtttaaagccatcacaaatacatcagtcaatggcaacaataggagggtaattatggaaatgatcagtgtacagcaggcagaagacatcatcttttctcaaatcagaaatttcgggacagaagaaattttctatgaaaatgccacaggacgaattttagcagaaaatattctggcagaccgtgatttgccgccttttgacaggccaacggtagatggaattgccatcagttttaaatcctatgaaaggggaattcgtgactttaccatcaaagctgtacaggcagcaggagaatctccactttccattgatgatgaaaaggaatgtatagaaattatgaccggagcagcactgcactcttcagtggatactgtaatacgctatgaagatattctgatcaataacaatgttgcgggcattaatattgatatgaaaaaaggacagaatatccatctgaaaggaaaggataaaaaggcaggagaaatacttgtaaaagccaatcaggtcatcacaccatctattctcgggattgcttcgtctgtgggaaaaacatctttaaaggtaaaaaaacttcccagagtcgccattatttccaccggagacgaaatggttccgcctgaacatactcctaccccattccaactgagacgttccaacggaattactatacaatctgttttgaaaaaatataaaattgatgctgactggctgcattggaatgatgattttgaattgataaaaaaggaattatcccaatgtattgacagttatgatattctactgatgagcggcggggtttctatgggaaaattcgattatttgcccaaagcctgtgaagagctgggaataaaaaagctttttcacaaaataaaacagaggccgggaaaacctttctggtttggaaaaagccaaaacgaaaaattggtttttgcattccctggaaacccggtttccgtattcatgtgcctgcaccggtattttattccctggcttgaaaaatctttggaaatccgggaaaaacctcaatatgccgttttacaaaatgatattgattttcccttttcgttacaatattttgcccaggtaaaactcagcatgaatccatcaggacaattaatcgcagaatcagtaaataccaatggttccggagatttttctcatcttgcggaaaccgatgcatttatagaacttcctctggaaaaaactgtgtttaagaaaggcgaagtctataaaatctggagatataatttttaatgtaatcatgacaaatttttcacatcttaataaaaaagaacagcccggtatggtgaatgtaggcggtaaaaaagctacccaccggaaagccactgccaaagccattgtggtgcttcctgaatatattctggaagcgcttcaaaaagatgattttaaaactaaaaaaggttctgttttccaaaccgctatcattgcagggataatggctgcaaaaaaaacgggagaattgattcctctctgccatcctattggtatggacaactgtgaaatagatattgaaattaatgctcaaaatgaaattgaaatctattgtactgcggagatcgaagctaaaacaggcatcgaaatggaagcattgacaggcgcatctgttgccgcacttaccatttatgatatgtgcaaagccatgagtcatgacatcgtaatcaaagaaatacaactcatcgaaaaatccggaggaaaaaatgatttcaaaagagactgatgttccccaattaaacgggctggtactggcaggaggaaaaagccagagaatggggaaccctaaagataaaatcaactggcatggcaaagagcagcggtattatgcggctgatcttttagctccattttgtgatgaggtttttatttcctgcagacaagaccagctggaaaattttgatccaaattacaatgcccttactgatacttttctgaatatgggacctttcggcggaattctttcggcattgcgcttacaaagagatacggcatggttagtcgttgcctgtgatttacctttattggatgaaaaatcgttagagtttttaattgagaacaggaatatagaaaaagcagccaccacttacgaaagtccttttgacggattaccggaaccattaattactatctgggagcccaaaagctatcctttgctcctcaattttttaggatcaggaattacctgcccaagaaaagttcttatcaacagtgatacattgatcctgaaaccaggcaacccggattctttaatgaatgtgaatactcctgaagacagggaaaaagcccaggaaattttaagaaaacagatttaacagaaacagatgagtaacccgcttgaacgttatcattgccagatggctttacccggatttggagcttcgtctcaggaacttcttaaaaacgctaaagtcctgattgtaggtatgggagggcttggctgtccttcggcacaatatcttacttcttcaggcataggaacaattggtcttgccgataacgataccgtctctgaaagcaatcttcaccgccagattttatatgctccggaagatatcggaaaatcaaaagttgatattgctactaaaaagttacaacagcaaaatccatcggtaaacattattccgttcaatttccgggtaacctctgaaaatgtcatggatttgatttctcaatttgatctgattattgaaggaacagataattttgaaacaaaatgtctcctgaatgacgcatgtgtactgacgggaaaacctttggtatatggtgctatttaccaatacgaaggccaggtaagcatctggaatgttatacagaaagatggcacttattcccctaattaccgtgatgttttcccgaatgcggaagaatcacaggtaccgaactgcagagaaggaggcgtactacctacactggcaggaatagtcggatgtatgctggctaatgaagctataaaatattttacacatcccgaagattcactggcaggaaaactctggatgatgaatgtgctgaacggcaaaacccagattatcagattaagaaaaacttccgtgcagattacaggtttgcctcagaccatagaaaccattacgtttgagcagctgatgcaagaaaaggatcattttgaaatcatagatgtccgtacaccacaggaacatgatgattttaatatcgggggaatcaattttcctgtagaagaattacagaaccattcagattatatttcgggttgtgacagacctattttagtttactgtctatccgggaaacgcagtgcagaagcggtgagaaaaattaaaaatatctttcctcagaagaaagtgtattctttaaaagatggtattcaaaaatataagcatacatgacagtaatttatgaattaagagaagcaacaatcactttcgcttttcgacattaatcaataatattctgagccattttctgagaaacagcaatatgttctcccaccatctcatgaacggtttcatcaatcatgacacacatactgttaagggctaaatcattcgcatctgttccaaacggttcctcaatttcgtcagctattgcttcaaacgcaacaaatgtataggctacaaataccacaataagtggtgtaaaccatccgagcgaatccaccagtccgaaaggtaacagaaagcaataaatgtataccgtccggtgcagtaaaaccctgtagctgtaaggaatgggagttgaaataattctctcacagcctccaagaatatcagacagtttatcaaaattttcatcaaagcgggcctgctggatagaatccagggaaccttcatcttttaaattctgtacccattctgcaagcaggcgcatcattacagccggtttatattttgattcagcaacaattttcagctgatcttcatcaagtctggattttaagtcttcataagcatctgttcctctaagctgatgtttcaacgcaaaaacaaaggccccaagcagctgcacaaaattatgaactgaagcctgatcatcttttatatttttcagcgtgatggcctggcgggtcagtgccctggaagtattcagcagagcgccccacagttttcgcccttcccagaatctgtcatagctggcattgtttctgaatccgaggaataaagccagtacaaagccgaacaaggtaagtggtgccggatttagcggaactttaaacgagagaatgattccatgaaaataggttaccagtaaagaaagaattaaaagcaatcccaaacggggaagcagggcgggcaaaacagagccatgccacacaaaaagcattctgaaccagtgttccttttttcttatgatcattgctgaatgataatttattcaaatactatattttatggttgttcgagacttgttccggaagctgcaactacatgatcatcaatctttttaaaaacagcaggatcatgctttcggattttgatacggacatatttggaagccggcatattggcaccgttcaccacgttattgatagataccagtacattagtttccgggaaatacgtcatggtacttttctgaggaataggatattttacaacaatgaaaagtggtgcaatcctttcaattccatcatcataattgaaaaggtctacgtgatctccttctttgaggcctgctttttcaatatctttttcattcatcattacgactcttctttcattgaaaatcccgcggtagcggtcattcaaaccataaacaaccgtattgaactggtcatgtgttctggtggttcccattaaatattcgtcttctgcaagcgaattatctggtacggcagttatattgaaagccgcttttccggggtaaaattcgctgttgaatttcccatctcttggtccgttcggaagataaaaacctcctttctgcactaccctttcgttataattttcaaatcctggaatgcattgttcaatatcattacgaacagcatcataactgttgataaatttgtcccaatccactacggaacgttttcctaaaaccgcttttgccattctgcaggccacatgagtttcgttgatcagatgttttgaaataggatcgagaactcctcttgaccattccacaacgcccattgaattttccgtacttacgtgttgaagctcaccgtttactatatctttttcacttctggaaattaccggtaagatcaaggcttcttttccatggataaggtgacctctatttaattttacagaaacaattactgacatttctaattttcgcattgcctctgctgtaaaagttgtatccggtgcggcagaaaggaagtttcctcccatgcagaacataaatttcactttaccctcatgcattgctttaagcgcgtttacaacgtcatatcctccttttctgggtactttaaaaccgtaatattcctccagtttatccaattgctcagttgttggatgatgattgataagtaacgtcctgtttccctgtacattactatggccccgaacaggacacgctcctcctcccttgattcctatgctccctttcatcagcaggatattcacaatattgtaaatcatttccaccccgttgtgctgctgtgtaattcccattccccaacaaatgatgatccgttttctggaggcaatcatctgtgcagcttctcttagattctcaacaggaatgccacattcttccgataagaaattcaggtcataccgttttaattcttcaaccaattcattgaagccggcagttttatccgtaataaaatcatggtcaagaacttttcccgggtttttggcttcttcttccagtacgagaatttgcagtgcttttaaaagcgccatatctccattaatttttacagggagatacagatctgacaattcataaggcttattgagcaaggcacggatttcctgaggattcctgaaacctttcaatccggcttcaggaagcggattaaccgctataatttttgccccgtttttctttcctttagttaatgcggaaagcattctcggagaattggttcccggattttgtcctatgatcatgatcaggtccgcatcgtaaaaatcttccagctttacggttcccttcccaattcctatgcttctggaaagtgcgtaaccggaagtctcgtggcacatattggaacagtccggaaaattattggtcccgaattcacgggcaaataactggtagacccaggtcgcttcattacttgttcttcctgatgtataaaaaatagcttcatcaggcgaatctaatgcatttagtttttctgcaatttttttaaaggcatcatcccagcttatcggctgataatgtgttcctcccttcggtaaatacatgggttctgccagtcttcccaactggctgatttcaaaatctgtcagctttgctaaatcatacaccgccttttctctgaaaaactctgctccgatcttttttgaggtagcttcttctgccagggcctttgcaccgttttcacaatactcacccagtctggaacgttcatcatccggatccggccatgcacaactcggacaatcgaaaccgtcaaactgattcatactgaaaagggctcttcctccgcgaagaacagaggcattaagcaccaactgatccaatgaatgaatcactgcaggaacacctgctgcccaggccttgggtggtttcagctttagatcctgaagtttatagggtggttctgcagaaggtaatctgctgctttcttttttattgaatacatctttgttttccatgatttccaggtttaaaaaaatgaaaaaatcagcatttcaggttcggattgggataattgtcgctttggtcttccaaagtattatcaatgcatacaaagtctttttctattaagagtttaatttttccggtctgcccttcaaaaccgactctgtctgtggaaatccactctgttatcattaatgcaggcattttcagaactattctgttttcgatgaaaactgctgaaagctctgtatcttccgttctttcaatcgcgtaaataaacggacggtctacaaattctgtaaagcttgaaatgataccgtcttcccccaattttgccacttcggactgggtaagacgaaatctgactgtattatctttaattcttattttcataataaattttcaatgttaaaatggctgccggaatggtaaatattaaaacggttgtcccggagaaagcccagtaaagtaatatcaaattctttggacagatccactgccaggcttgaaggagcgcctattgccgcaacaatggaaattcctgccattgccgctttctgaataagttcaaaactggctcttccgctcagaagcaaaattttattgttcaaaggaagcaaaccggcagatagtgcatatcctatgagtttgtccaaagcattatgtcttcccacatcttcgcgcagtgccagaaggtttccttccagatcaaagataccggaagcatgtatacctcctgtagcactgaaattattctggaatgactgcagtttttcagacaactgatatagcgtttccagggaaacttctgtattttcttttgtatggttacggaaagcgcttactgttcttatagattctatggacccttttccacatacaccacagctggaagtggtataaaagttccggtcagccttcatcagttcaggaacaaaaccttctgcaagctcaacaatgataacattttcattatttctggaacattctgcctgtggagaatatatgcttttaatctgttcacggccggaaataatcccttctgtgaataaaaacccttcagcaagttctgcatcatttccgggagtccgcatggttacagaaatatttttagactcttttttaccttcagcgctgtaagaaaccctgatttccagaggttcttctacagagatatcatctgtataagggaaactgctgctttccctgactttgatgatttctatctgctttacagatttatttgacaacagatttgctttcatgatataatgactggcctagtaaaggtacaaaattttattcctaaaattatgggtgtgctgaaacccactcttcaccatcttcaaaaatttcttttttccagataggaacggtcttttttatattttcaatcataaagctgcaggcatcgaaaaccgcatttctatgcccgtcacttaccacaatgatcacggcagcatcaccgggaaacaagactcccgtgcggtggtgaacaacaatattcttcactgaaaataaggaaatggctttatctgctattttctgtatttccttcacggccatagattgatagcattcatattccagacgggtaacagatttacctttggtatgattccgtacggttcctacaaatgacgctattcctccgcatgcaggatcggagccaagggcaaagcaatctgtaagatcaagtatttgttctgttatttttatatcaaccatatctattagccaccgcttaccggagggattattgctatttcgttagtcactgttatgatctgatcatcttctgcatattcatcgtcaacggcaataaaataggattttaattttttcagttccggaaagtctttttccagaagctccttgagtgctttgacacttgctccttcatgtatttctatttctttttctgaagttccgaaaatatctttcgttattccgaatgccagtattttaagtttcatttttatatgtagcttattaccaatattttattaaaacgtttattccggctatcaaaaccagaacagccgtcattcttttgatgactaaaggattccatttcagggacatcctggaaccgatctgcccgccaatgaacacggcaaaacataaactcatgattctgaaataatccatatctgcagacagcttagataactggccaaagattcctgatattgaatttaccaatatgaatacacttgacgccgctgcaattttccgtggggtatcccatttcatgaggtttaacaatggggaaagaaaaattccgccgccaatgcctaccaatcctgataaaaacccgattcctcctcctaaaaagctgttttttaaaagagatgcttcgccgtattcctgaagattttctccattttttgcttctgtctttatccaaagcaacaatgcagccatgattaaggtggcacctaataccaggaaaaaagtttcctggcttatttttaaaacagctcccaggtatgccatgggaacacttacaagggtaagcggcagtattttcttccaatcaatctgcttatttctgatataaatgaatacgcctcctattactacaataacattacagataagtgctgttaaccgtatttcctgataaggaagactgtacattgccagaacagcaaggtaactggatcctccaccaaatcccacagaagaataaatgaaagcgatgattaaaaaaaagaaaaagatttcccaatgccccatattttttgcagaattaattttcttacaataatactcatttttaaggcgtcattcagggttatcacttaaaagtttctgttataatttgtgagaataatgttgcagattgttttttaaggatggaagatggaagcctgaggatggaagttactattggacctatcaataaagagttaaccaatacttatttctattctcaaacttctttagccaaagatttacactgcttcttttgtttttgttacgctcttagcagcctcgattttcttagtattcctaagttcacgcttcattttacggtagtcccagggagcaatggcattactatcctgccaaagtcctatttttttctgctgtgcagcttcctgcagttttcccaaagaggcatctttggaataggaaaaataccaccatcccaatcctgctttgataagctctttggaaaggtatttcccatcgtcataatacactttcgcaatggatcttccataacggtctgtagtggtttcaaaaaagcttacggttttcccaaaaacctgagcagaagtaaactgttttgcatttttaccaaacgcctgcccattttctggacaatcgacttctgccagcctcagctttttttgctgattgccttttaacagtaaagtaatggtatctccgtctgaaattttgatcacttttccggtcgtctgtgaatataggaatacagggaaaagtacgtacagcagcattaatcgtttcatggggcaaatataaggattagtggggctttttaattaaaaaacctcacgttttgcgaggttttttatattatcaaatttaaattatttgatttttttcacctcaaagttgggagaatttacgaagtgagcgaaataatcttagtattctcgcgcgatttttaatattcagaaatttaaaatccagaagtccacattaggttatttaaagtaaatttactaactataaaatcatcagggtaatttttaaatccatctttcttcttacaactttcaataactttatcagttgtttttttatctaaaaaaactccaataattctctcatcatctaagaaggtattaatagtataagtatggctgacttgaaaaatatattgtaggttcaattcttttattgatctactttcctcacaaattatatcttctttaattaaataatctcgtccaatttctcctacaacactatcaaatcctttttcccaatcaatactatttaattcatacttcctaataaccattccattaggatactctttaaacccaggcagagccaaagctttttctttgtccttctctaacttttccaaatcatcataatatcctagaaattttctgttagtgtgagtctcatcggtatagatatgctcaagtgcatatacaaagtaattcataatatatttatttctttttaggtgggttttgaaatgatctatcaccccatttctttattccttgatattccgagccaggccctacatctgcttttgttttattccattctccttttccatattgttgatccattaatcgcttagcaaaattttccattcatctatttttattaaaatatctgtactggcatattcccataaaaaaagaataaacttttcggtcaggaaaaaaatcacccatttgaataccgtcctcatgattataaaacaaccataaacttttatatttaagttctttacaattgaaaaatcttaacaaataataactgttcgaatctatatagtatgtcataaaaaattactgtttgttttcttgaaatcactgcgaaatcattttgaacgcttttccaatgcaggaatgtaaattgtatagaaatattctttttccattttttataattttagagcaaaccaccatgaacaaacagtttaaatttttaaaaaataaaaaaaggaataaaaaaacgaaaaattttccctcatttttaaaataagttaagtcaatggttattaacctggtaaaggtaataaaaaagttttcatgaaaaattaattaaaaattattctcaattttatttttttatttgaaaaagtattgtacctttgcaaccgcaaaaacgaagtaaaactcgttactgatgacaccctcggggcgtagcgtagtccggtcatcgcgcctggtttgggaccaggaggtcgcaggttcgaatcctgccgccccgactgttttaatagttttttcaaaattatttaatgggtgcgtagctcagctggatagagcatctgccttctaagcagacggtcaaaggttcgaatcctttcgcgctcacttaaagacttactggaaacagtgagtctttttttgcttatcactcaaaatcattgacagccaaaaaattgagcatcccggttttaatcgggacggccaaaggttcgaatcctttcgcgctcacttaaagacttactggaaacagtaagtcttttttgtttttatctcattattaaaaatcttttgcagctaaaaaatagagcatcccgattttaatcgggacggtcaaaggtgcgaatcctttcgcgctcacttaaagacctactggaagcagtgagtcttttttgcttatcactcaaaattatttacagctaaaaatagagcatcccgattttaatcgggacggtcaaaggttcgaatcctttcgcgctcacttaaagacttactggaaacagtgagtcttttttgtttatcactcaaaataattgacagctaaaaaatagagcatcccgattttaatcgggacggtcaaaggttcgaatcctttcgcgctcacttaaagacttactggaaacagtgagtcttttttgtttttatctcattattaaaaatcttttgcagcaaaaaaatggatcaggcgcaaaactgcgctcaaagtttttaatctagaacaaaaaaaccactgataaagcggtctggatattcatattttacttggaattacagcacaaaactatctttcaatagccgtgctgcatttagccacaaaccgctcaaacttacggtctttattgtgcaagaccggtccgtgaccaaaacagataatggaaggattcaattctgctaacttttggagtgatttgatatttctctgctgatccgaggtgaacatgtttggcggaaggtgcagaccggcaactgtagtgagcaagttcatgtttgttgaagcatcaccaatgatcagtacaccatcccgttcacggaataaagaaatatggccagccgagtgtccgggcgtctctattacccggaagtttcctatagtatcattttcaacgaccgtcttatcaactttatgtccctgaccggcccaatatttttgctgaagctttgctacccaatgttgtggtgttggatagtcgattgttaccatacctgtttctgttcttagcacttcgttaggatgacatagcaaaggaattccgaactctgcgcatatctgatcgctgcagccctgatgatctgcatgtgcatgcgtcagaatgtgttgataaacaggaattttcccgatagctttttttacagtagtgtatgagctccgtattcctgagtctaccaatataccttcgataatataactgttgatactgtttcgtggcatcagtggaatatggaatacttcgggagcaatttgacgtaacatagttttttttgtgcaaatctacagcgattatcggaactgcataaggacatttgtcctataatgcgttaggtttatgaatctgtccctttgctcgtgtaagcgatcgttgtgtaatgcccagatacgatgcaagatcctgtgtgcttacgcgtcgtacaagcattggttcgttaaaaaggacatgatggtatttatccaaagctgacttattattataattcagcagataactttccttttgattatactcctgctccatcacggatctgataactccgttccatgaagtaaccttctcaatcaaatgtcgatagtcagagtagctgattctatagatgacactatcttctatagttctgatactccttctggatttttcctgtgccacaaactccggaaataaggtggcaaattcattttcaaatttgaaacaggtaatattttcctttccttcttcatcaacagcatatgcttttacagcgccactaacgataaacccaatataacggcagacttcatcctcacgaataaaaaaatcaccttttttcaggctgaccggtttgaaaaactgtgaagaaaagttgatttcctctgctgacagctctcctgtagagtataggtaattttcaaatgcgttagtcatttcaatttttttcgtctttttttcttattcaaatctaacaattattatacactcatccacatccttttttagtttaatacacattaccagaaatgaactttcctgttgctgaccgttactgtcctatttcgtcaatcaatcaaattgtcataaatttgtctgactctattctaaaccaatgaaaaatctcaccttcattatcgcaggcggtcttttggccctgactacatcatgcaaaactccggcttcggtttcaaaggccaccgttcaacatacaccttaccaaaatcttggacttcacgggaaaatatatggtgccttttatcagcagcgggcggctgaatatgaagctttatgccttcaggcttataatattgcaaagcttcgtttagacgaggccctggcacagaaatcagaaaaaccgctggctattgtttcagatattgatgaaactttccttgacaattcgtattatgcagttgagcgttcaaaaacaggcaaagggtatgatcaggccacatgggaagaatggacagcaaaaggcattgcaacacctctcaccggttctcaggaattttatcagtatgcagcaagcaaaggtattcaggttttctatgtgaccaaccgtaaggagcaggaacgtgcaggtacattaaagaatctgaaaaaatacaattttcctcttcaaaatgactcccatcttattcttcgtacgaaagaaagcagtaaagagaaccgaagacaggacattgctaaaaattacaatattgttttattattaggtgataatcttgccgacttctccagcctgtttgataataaaacagaagctgaacgttctgcagcagtaaagagttccgcagatgattttggtaaaaaattcatcattattccaaatgtaggatatggcgactgggaatcatcattttatcattacaaatatgattataccaatcaacagaaagattctatgatgtataatgcggtaaaggccaatccttagaaatcagaaataaaaattaattcttatagcaatacaacattttgacaaaatttgtttttttgtcaaaatgttgtatttttgtatccatattttaagaaatgtcatctcaaaccgaacaagaccaactttcacatcaaatcctggaaactgcttcagggctgtatctgaagtatggcctgaagaaagtgactatggatgatatttccaaagctgttggtaaaagccgaacgtctatttattactattataaaaaccgcgaggaagttttccaggctgttctggccaatctgatcagggaagttatttcagagattgatgccaatatgaagaaaagaaacacgtttgaaggaaaaattgaggagttttgtctttccaaaattaaaacttctgaagaaaggtcttcatttttcagagctattgaagcaggaatggataatgaagaaaaatcaaaacatattaccgatgcccacaataggatgatggaagcagagagaagtctgctgctcaatttattttcaacaagtatcagcagccatgaaatcccggatgtctctattgaagagcaggaaatcattatttttatcctgcagagcagtatcagaggtataagacgtgaaatgggtttaaaaaacaattttgaaaatttaaatacaacagtaaccactttgacatcaatggttattaaacatatcagttaaaattttttatccaaattttgacgtttttacattatttgtcaaaaagtttattttgaaatatgaacaaattaagtaatatcagcacattccgggcgttcagaagtacaaattatacgttgtacttttttgggcgttctgtatcgcaatttggaacctggatgcagcgtacagcagtagtatgggttgtgtacagcatgactcaatctgcgtttatgcttgggctgaccatttttgcggagcagtttccatcttttttattctcagcattcggaggcgtagctgccgatcggtataaccgatataaaatcatacagatcactcagattttatcattaatacaggcttctttactggctttcctggtcatgacaggacaccagaatatctggagttttatcatattaagtgtttttctgggcatcatcaatgcttatgatgttccggcgcgtcaggcgatgatcaacgaagtggtaacagatgatgatgatcttccgagtgccctttctctgagtgcggcgatggcaagtattgcaaaattagcaggtcctgccctatccgggatcattctgcaaaaattcggagcaggaacctgttttctgatcaatgcagccagttttgcagcagtaatggtttccatttccctgatgaaaataaagattgtttctaaaaagccaactaaaaaaggaactttcacggaactggccgaaggtttcagatatctgaaaaaagaaccttctatcagtcttgtaataatcatgctgagtattacgggtttactgatcttaccttatgacacgttaataccggtttatgctaaggaaattttcaaaggagatgccaagacattcggttatatatcaagttttattggtatcggagctgttttgggcactgtatttctggcttcgttaaagaaaggagcatccatgagaaatattcttatcctgagtacaattatcctgagtatggggctgattcttttttcatatgccaccaacttctactggtctatgttctttgctgcactgacgggattgggaggcgttgcacagtttaccacctgtaatattattgtacaatctgaagtcattccggaaatgcgttcccgggcaataagtattcttctgaccgctatattcggaatgctgcctttgggaagtgtactgattgggtttgtttcggagagaataggtgctccaaaaaccttattgctggaaggaattgcaggaattctaattgccgttgttttcaggaacttattatttaagaagaataaaacaaaagctgtcaacaaagaattgcttgaaaaatctgaggaacaatttatcaataaagtataataacaatggaaaaaacaaacacagcattactggtaatggacatgcagtcggctatcgtcaacacattacctgatacaacggcgttgatctctactaccaaagaggttatccggaccgcaagaaaccgtaatattcctgtcatttatattactgtaagcttcagacagggaatgccggagatcagtgcaaataataaagccttttctactataaaaacccgcatggcagatattgatatgaaagaatgggcaacaattcatccggagctagctcctgaaaaagatgatattgttataaacaaacgaagattcagtgcttttacaggaagtgatcttgaagttgtccttcgtggactggatattcagcatctggtgctgacaggtgtatcaaccagcggcgttattttatctaccttaagagaagctgcggataaagactatcagcttacagtaattgaagattgttgtaaagatagtgacgaagaggtacaccgcgtgctgatgaataaagtgttcccaagacaggccgatattactgctgcaagtgactggataaagtaaataagaaaaagacaatcatcttttgcttattttggttatctttaagtaaagaatacgaagaagatcattaaaaaatggagaggcttaccaataatactgattaatcattttaaaaacattaaaatatgtggtgggtatatgcaattctttcagctttttttgcttcattgaccgcaatttttgctaaaattggaatcacaggggtaaactcaaatctggcaacagccataagaagtgttattattttactggtagcctggggaattgttttcgcacgaagtgaatacaagggaatccctgcactttccagacataatctgatctacattgccgtttccggaatggcaacaggactttcatggatattttactttaaggctctgcaaatcggaaaggtaacgcaggttgccccggtagataaattaagtgtagcgctgactattgtcctttctgttgtatttctcggagaatcactcacactaaaaaccgctataggagcactattgatcattgctggtacagtactcttaatttttgaataaaagcacacagatcatcttatccgtttcattgggttaaaataccgtttcaagtgtctatttcgctgaatcagcacaaattttgcccattgagagaacagtacatactacttttacactgtaaacataaccgaaaggccattggattatcttaattagtatgtaaaacattggttaaggatcaataaaaatctttttgtgcactttaattccttgcagcctttaatggctcaactatacacttaatcatgtttgggtaggattggcttgttccagtcctattttttatgcttaaatctattgtaagagcataaagttctagtaaagaagaaaaccgctgtaaggacaacggttttcatgtattgagaataaatactattatttaagtttataggaacttccgttccacaggtaggttttggaagattgttttttcttttccctgtctttctcatctacctccatatcttccactttaaggataaatgcattgggtattcctcctttatcattaggaaaaacaaattcttcgctatgataaaaagcgccggcatcccccacattcatcaattgtggaagagcaatgagttttttatctttaaaaagaacatactgatcatagccggcaattccacacgcttcaccagaaactcctgctttaagggtgaattcaacgttttgcagtttgtggctgctttctatattgaaagatccggagctaagctcttctccttttccggtatcaaaatacacctcattaatgagtgtatttccctccatcacttttattccggcaatgttctgtttttcgatctcattaaattctttgttcttcctgtcaattgttttggaaagtccgaaaagaaaatcatatccgtttttgttacggtatcctacacaaaggttaccgccccagacgtatccttctaaagtattgtcacctttctgataagatattttataccagtttgcggctctttctcctaatttcagaacgccttcttcctttttaagaatcattacctgctgattggcctgaagtgaatctgcaatcttgccattcactcccggatccagtcttacacgggtccaatctgtaaagatcttctgtgctttattttcttcgaaaccaaagattccatctgcatatgcttcattttcctgagcggcaaaaaactgcagcatcagtaagaataaagctgtccataacgttttcatatttatattttgttttgtgtgttatttttcaagcagaagacttacccattcttcacgctgcaactgttttttcagctcaagtccgctttctctacatacttccagaatatcatctacatcaaagaaacacaatcctgaaagcaataatttccctccgtcattcaatactgaaacataagtcgggatatctgaaataaggatatttctgttgatattggccaggataatatcataattctctttgcctaagttttcagcagttccctgttcaatatccagttctacattgtttcttactgcgttttctttggagttttctactgaccattcgtcgatatcaatagcttttgtatcccctgctccctgctgttttgcataaatggccaatacagaagttccgcatcccatatccaatactttcttcccattgaaatcaatatccatcatctgctggatcatcagatgggtagtaggatggtgtcccgttccgaaagacattttaggttggataataatttcatgcattcccggtacagattcatgaaactctgctctgatcaatactttatcatcgatattgataggagagaaattcttttcccattcttcgttccagttgatatttggcatttcgtcgaaggaatattcaatttttacgttttcattttcaaagatcggaagagccttcagctgatcttcgttaaataaatctgtctggatatatcctaaaattccgtcaatttcttctgtaaagctgtcaaaacctatttctataagctctgccattaaaatctcattccagggttgtaatggagaaattttgaaattgaattctaaataattttgcatgtgaataatttgctgcaaaaatactaatgttatcacggttaaaaaaatgatggagtaaattttggctgaaaccggggatttttatgtttttttgaatggatgaaagctaatctcattgaataaatgcgatgggaaagtttattgcataatttttcccaaggatgatacagatagatgatcatattcaatagaggcgggctttagcccgtcttcagaatcaatacaatgccattggctttagccaaaacctataaaaaaacttgaaaataaatattaggattgttttttgaaagactaaaaattctaagttttggctaaagccatacagtacacggtaaaaagaaagcgggctaaagcccgctcctattaatttttataattcaaggcagagtaatagttctttgcagaaaaatagtaaactttaaaccttgaactttgaattttaaaaccttattatggattcgtagagaatatagaaccgtttgcgatcagcgctcttctgttcattttcaggatatctcttacccattctgcaaaatcttccggttgtaatactttatcaggatttccgtctgtaagaccgccctggatactcatatctgaagcaattgtacttggagtcagggtgatgacacggatattctgttttcgccattctgccatcatggattgcgacagagatacaacagcagcttttgaagcggcgtatgcagacatattcggacctcctttcaaacctgctgtagaagctacgttgacaatatctccttctcctttagatttcataaatggatagactgccttagctgcgtaatatacaccgaacagattggttttgataacctgttcccatgtttcagaaggcatttcttcaatacttccgaagtctcctattcctgcattgttgatcagaatatcaatccctcccaattgttctgctaaagattcaattccagcttttacctgaatttcattgtccacagaaaaaacggcgtatgctgaatttacccccagccttttgatttcttcaaccgtcattttaagattttcttcgtttcttcctgtaatggcaacgtttactccttcattggccaaagctaatgctacagcttttcccagtcctcttccaccacctgttacgatggcattttttccgtttatattcatagtaatgatacttttcttgatacaaagttacgaaagaacatttttatgaagcggtgaaaacacggatttaacttatattttattcaactacaaaagtcacaaaaggtttcatttaaaaacacctgagtcctcttaagtaagtttaaaaagataccacagaaaagatcacataagatgaagatcaaagattttcactgaaaaaacttaagtgtttgaaacttctgtggtgtatctatgcttcattaaacattaaaaccagctcatgagaaccggtttcaaaatctaaaaaaggtatagtaaaaaagtaaaaagcttaaggaatctggattggattctgtacttcaaactcttctgaagcggagaattcatttccatacatgtcaacagcctttacctcaactttatgttttcccaatgataatttcttaggaaaatcagcttcccagatatgttttgacatttcaggattggaaggtcttcttcccgggaaaattttctctgtggaatcccatttgaaaacggaaagggcaaaattcgggtcgatggtttcgtcatattccatttcttcccattttccaccgtctattctatattctactttgtcttttttgcttcccatgaagaaattagccagcacttttgctgaagttcttgaggaaggaatcactttcggaacatataatttgatctgataatcttccggctttccggctgttttgtatttcactttatactgattgtctgtaaagctgataaaagaatatccttttgcagttccgtctctcatcgtagaggtgggaagtcctgcatcatccggtgttcctgagtaccagtctccgcaagtagttcctacgttatattcgtgcaattccttgattccgttccagcctgctttttttccatagaaaatctgttgctgaatgtgtgtatgtgccgacagcagcaaaacattctggaacgggtttaagaaatcaaataatttctggcggtccgcatttctgaagttgtcttcattgttatgctccagcggaatgtggaaagagatgacgatcagtttatttttatcaaccagtttcagatcgttttcaacaaaccgaagctgatcttcacggaatccaccccagtatcctttgccatctcttgggtccggatagagaatatcatctaaaatgatgaaatgtacatttccgtaattgaaagaataattggcagggccaaaattggattcgaatgtttcatcggaaagcttatcttcttttgcatcatagttcatgtcatgatttcccatcacattataccaaggcaatccgacttctttcatcacctctgcgtaaggtttctgaaggcttaggttatctcctaccaaatctcccagacttattcccaatactgcatttttcttcgtattctttacttcgtttacgattcctcttttgaagtaatccagttctttttctgtgtaaggctgcggatcaccgaaaacaagaatgtcaaaatttttgtcttctttttgctgataaagcggaaagttcagttcttttggaagatctcctgtaggagccactcctttgtatttaaaatctgccggagaacctttgggtttatgatggtaatagaattgcggaagattatttgcgtttaaagcagtctgatatcctgaaggcttgattacaaaaacagtctgatcttcctgaaccggaagactgtatctgccgtttttatccgtaagaactacctgaacaccattagaaacagctaccccttcaattcctttttcccggttttctttcttttgatttttgttactgtcttcgaatacatatcctgaaacagaagcttgtgagaaagccattgctgaaaccaacagacaaggcataatgcattttatattgatactcattatttttaatttttaaattattttaatctttaaatttcagttatttattccaccacattttcacgttaatattgtctcctcccattgattgtacagccgcgttataattatccgtattcatcacttttgtagccgtaggatacatgaatctcacaggcatttgtccgccgttctgaagacctccgttattaggaagcaccggtagttttgtacgtctgtattcataccattgctggtgatcaacaaaaaacagggaaatgtacttctgaagcataattttttccagagaaccgtcataggctactttcggattgctgaaataattggcaggaactgttgccccccactgttcaataatagattttactccggtttcgtagtaagtttgctgatttcctgcaataattcctttattaaccaattctgccaggataaactgcacttcagaataggtcatgattaaaatttttaaaggggctttcgccaggttttggttaaggttggaaggctgatagttgaaagacgttcctaaagcgtatcctgaaggagctcctttataaccaagatcttctcctgacgttgctttagctttagtgaaaaacatgctcagtcttggatcattgttatctctcatagcatttacaaagaattcacctgctgccctgtacgctgtaaaatcctgtggacgggctattggcggcaagtaaggagatatccccgaaagcggaagcaccgcgctgtctgtattattctgaaaaataggatattgagcaggattattaactatttcctggattctttcgtatacatttacttctccgtttcggtttagaattctggtcagtaaccttaatgaaagggagttacagaatttcttccatcctaaaattccggtctgactattggtgttggcattataaaacagatctgtttccgttaacgcctgattggtattgaataatgagttagctgttttcagatcatttaacaactgaatgtagacatctttctgcttatcatattttggtcttaaaatattttcttctactcttaaggcttcggataaaggtatatcaccaaaagcatcagtaagattggaggcaatccatgcattcaggaccattgaaatagccagataattattattctgttcttttgccgcatattttctgagatcacttacctgcttaagccatctgtatgaagtattccagtagccgttaccacttttttcgtccatataatatctgctgtaggaatttccttcattgggaaagtctaaagcgatctgcatgatatcaaatgtaaaatcatctgctctgttatagccataacttcccatttcatactgtataggcgcaagaaggcttccaacggaaggatctttaatcttactcgtatctgtattcatttcctcgaatgttctgtcacaggattgaagcatgaaaacggaaattaccaaggctagatttataattaattttttcatttttaaagattttagaatttaagatttaactgaaaaccaattgttcttgctgttggaagctgtcccatctccacccccggagtgatggttgcgttatccagtgtagctacttcgggatcaaacatcgggaacttggtccacatccataagttctttccgaaaatggcgatggtaagatcatccagtcctatagattttatggtttctttggggaaggaataagcgattcttgcatctcttagtttaataaaatctgtgctgaagctgttggtttccacgttggctctcctgtagtaatctccgtaataggatgataccagaactccttttgtgttgggactgaaggttccgtcaggattctgaacaacgccttctcctacaatcattccgccaggattatctcttcccggaagggtagatttcagcttgccctgctcagacattttatgatgtgactgtgaatacgcgatcccaccatattgcccatcaaaagagaaactgattgtaaagtttttaattcggaaatcattctgaagaccggctctccatttcgggaatgcatttcctactttttcaatatctgcaggtcttgccggaagtccgttgtctccgtaaattacttttccgtccggagttctcagtaatttaaatccatacatatctcccagtgaacctcctacttccattttatagaaaaccacatcacctacattggaaacaattccgtcaaaaccttcaggcagcgtcatcactctgttttcattggtagaccagtttccaccaaccttccatgagaagtctttcccttttatggctaagatatccgctgaaagttccaaacctctgtttcggattttacctgcattaataatccttttagaatatccactttcggaaggcagcgataccggaataatctggttttcactgacattctggtaagcagtaagattaaggttcaacctgtttttgaaaagactgaaatccataccggcctcaatattggtatttttttcaggcttaagggaaggattattaaaagttgtaggcgctaccacacttcctgtaatattgctggccgtataatagttatccagaagataaggatcactgtctattcctacttttgcccatgaagctctcagtttccataagttcaggttattgcttttcagattaaaaatatctgataaaatgaaactggtacttactgaaggatagaagaatgatctgttttgcttcggaagcgtagagctccagtcatttcttccggtaatgtctacaaatactttattgtcatatcccaaggtaagcaacccgtatacactgtctacatgcttatctcttggtgcgggatatttaaccggaatactaagtgcattagtaaggctatattctcctgctgttttcaatccgatggcctgataatcattcagcagatattcattataacggatacttccccctgcagaagcggaaatactgagtttgttccaatctgctttgtaagagaataaaaggtcattgttatattcctgatttttgataaactgctccctgtaaaaacctttcagatagtttgcagaactccatggtcttttggtcgttctcttttcgttcaggatttcaattcctgacctcaacattaagctgaaatttttattaaactgataatctgccgtgatattccctgtaatggtcttctttctgactccattcagcatttcgtaagcaatcatataagggttgtctatataagaactaaatggatggatctgatcaacctgttcctgaccgggcttccatatcggtctgtaccattcaagatccacattgggattctgaaagatcatgaaataggaaatcgactggttgttatatcccgtcgcaggaaggttatcactggtagtagtgttataagcaaattttgttgatatttttaatttttgggtaagctgatgggcaaaagataaggcaaaattgaacctgtcgaaacctgtattcggcatcatccactcgttattcagatacgtcagtgaagttctgaagctggttttctcattggagctttctacagaaatactgtttgaatagttagaacccgctctccagaaacctttgatattatttttataaggtctccataattgtctttccttactttgtcccattacatcgggatcgtattggaaataatattgtccggcgaatttaggtccgaaagcactactggtgcctcctgtacttggtccatccggagaaaggccgtaagaatagtaaaagtttcctgctgtattggtagccagtgttccctgtccatattcgtactgccagtccggccattttaatactgtatcaaagcttgaagaagaattaaaagttactctcagttttccgtttttcgtttttccggattttgtagtaatcattaaggctccgttggcggcacgggatccgtataatgcggctgcagaagcaccttttaatacggttacagattcaatatcgtccggattgatgctgtttaatccatttccaagatcgattggaacatcacctccggaacctgctccataggctgctgtaccggaacctgtggtagaatttcccaatggtactccatccactacaataagagcatagttgtgatccatcataatggatttttctcctctcaaagtaattctggaagttcccaacggtcctgctccggcagtctggattttaagacctgccactttcccttccattgactgtgcccagttgttattctgggtttcttcaaatgttttggcttctactttttcggcaacataacctaaagctctatcgtgtcttttgatccccaaagcagtaaccactacttcgtcaagtcctttaaccgtgtcttttttagctttctgctgtgctgccagattgacgctgacgaatcctaacagcgataaaaccaacagtttttgtgtctctttacgcatttcctttttgtttgcgcaaaattagaacgacattacaaggaacaccttaacacacttttaacgtttcttaaaaatttattaaaccatttgttaatccagtcttaataacattagataaataactaattaacaaacaattaagcaattaagtatttttaatatggtttccagattgtatttatgtatctttattgtctgtctttgagataatactaaacaaaacaaataatatactgaattacaataaaatctaaacacttgattctttcatttacttttaaaaagaagggctaacttctaaaaaagcagcctgcttccatataagaagcagactgtataaattattggttatttgttgagatggttaaaaaatttcgtttgaccatccatcaaaattctttgaattttcgccatccctccggaggagggaatattctgtctttcagttgtaatctttctgaaaggttctgaattgtttatttgtttttcaactgatcagggatgtttgtggttacaaacccgattccctgattcttcagttcatcatatacggcgacatcattcacagtccaggcattggtaattaatcctaatgcttttgcttcagcaatccatgttgggtttttctggaaaacactgtagtggtagtccataccatccaatccttcttttttgatctgctcaggagacagctcgccgttcagatactgaactttaaaggatggagccagttttttgatttccttacagatattcaggctgaaggaaataaactcactttgagattccagcttcatatctttaatcattttaatcgttttctccgtgatttcattttctatttccggagttttggcaggcttaatctcgacaattagtttcagagatttatctttttttccctgcttcagataatcttttaaagtaggaaagttttctccgttggataatttcaacgcttccagttctttgaaactggtttcggaaatttccattttaccatggtgctcatcatgattgatcaccaatacaccatcttttgtcattcttacatcaaattcagacccatatacttttaatttctgggcattttccagcgattgaagtgaattttccgtggtaggaggctgagcctggaaataacctctgtgggcgataatctgggtttgtgctttcatcataactgtacttaaaactgctaaccctaaaataaaatttttcataatataatttagattattaaaaacaaagtcctgaaacttctgataaaggtagttattaaaaattgaaccacggagactgtatgtcttccgtggctcaaaagaagttagaaagtatattttgcaccgatctggatctggtaaggatttcctgtcagaggaaccaaaccacctccacttacgtttttggtgtattcgtactgcatcgtatctttattgaacttggttaccttatacaaagaagtatttgagtatgatttgtttaccccccattctttgttaagaaggttggctacgttgaagatatctacagaaagttcaaaggctccgaccttatcgaatttaattttcttggcaacacgtacgtcccaaacaccgtagaaaccgtttttacctccgttacgctctgcgattcttccgttatattcattgatataatctttcagagcctgccctacctgcggatcatccagtatggacttggtaagattagggaagataaaagcaagatcgttggaatctacaaagtctccgttgatgtttcctcctgtggttgctgagaaacgcgttcctccgattcctgaatacctgatccccaatgtaaatcctgcaatggttggagagttaccgtagatcactactttgtttctgaactggttgtctgaataagtcattctcagatctctgggatcactctggatcatggtagataatgttgctgagttggctacgtttccgttgtatgaagtattgtctttaatatcagaccatgtgtaacttgcggtgatttccccatctttccagtaacggtaacttgtatcgattacgaatgagaactggtttaccttaccatcgctcaccaattccagtactcttccgaaattattattgattctcccctgtttccagtcgaaacttacactgttattggcattattggtaatagcacctgtagggataaatactcctcttccgccttcattagccagggtgaagaaaggatttgccaccatgtttctgtcgtagtaaaagtaattatttctacccagagccatgtatcctgcaattcccgctctgaatctttcattgaagaaatgggtatacgagatattggctttataaacaatcgggatttttgcatccttaccggtataattgatggttggaatctgatactgggaaagtgacggaacagaattatagtcattcctgtaactgttgaaatccgggaacggaacatctttacctgttacatccactgtagccagatgttttccatcaaatacaaggttgttgatgatcatatagttgttgatatcggaagagaaaattccggcaccgaacttcaggaagtctttattttcctcattgatattccagtcaaactgaaatcttggctggatgacaaatgatttgatctgattatcggttctgattcccatttcatcaaacagtttctggttgaattctgctttcggataaccgccgtaatctaatcttaaaccagccattaaatcaagacctttagccactttagtctggaattgtccatatactccgatgttccaaatgtttgatcttacagacggatcggccaccaaaggaacttctctgtagaatctgtaaggtgtcatgttgtcaaaattgctcatcccctggaaatggaatcttccgttcacctcacttccgtatactgattttgccgttgtatacataaggtcagccccaaacgtatattttaccttatctgtattgtaatataaattatctacaagctggaatacattatttctgaagctttcctgagcaaaacgatgtcccccgatctgaatattcgtagatcccacactggaagatacgccttccacaatcgctctcggaaccggttttcctaattgattgttctgataactgtcctggaaagtataaagatactgagcctttaattcattggtcagattaggctgaagatttgatcttaatgttaacaataagctgttatcaagatttttatcatttccgtaagactcgaagaaattaatattggtgttatcacccaatccgtttttattaagatcgtatgtgaagttatttctaagcgttaataaatgtttttcattgatctgccagtctaaacgtaaaaaaccggcatcagagtttctcactttatcaaaacttccgaactgcggactgtttcctaccccgtatttttcccttgcaatatccagaaactggttaagtgtttgtgttgttgtattgaatcttttctcgtcatccggagacttgatatcagcaatgaccaatggtcttgaatccaactgatggtcccatgctacgaagaaatgcaatttgtttttaatgattggacctcccaatgaaaatccgaactgggaagtagagaaatcattatctcttttattccctctgatatcatatgggctggaaagccagttggttcttaaatattcccaggcacttcctgaaaacttattggttcccgatttagtaacggcacttaccgttcctcctccgcttctccccaatgttacatcatattggttggtggtgattttgaattcacgtacggcttcaatagagattgaaaacggcgcgccgcttcggctggtagtagatcctgcagaggttggattttttgcagtcatcccgtctatcgtaaagttggtggaagacccgagctgtccggaaaggttacctccttttccacttaaaggtgacagttccgtaaggttggtaaagtttcgtccgtttacaggaagcatactgatgttcttggcagaaattgcggtagctgctcccaggtttccgatcttgtttttaaggttccctgtaatctttacttcttcgatatgcttctcatttccaagatccatattgacagtaacctgatcaccaaaattcacattgtacccttcttttttatcatcattcacaatgacggtgtaaggccctcccagaggaatttccttaaaaatatactccccttttgagttggtttccgtttccgttctgaatcctgtagactcattcacgatcgttactttcactttttcctgagccgtacttcccggtccggtaactttccctacaatagaagcctgtgtggtttgtgcataagccattgtcccaagccctaaaaacaataatcccagtacaatctttacttttttcatttcttccgtagatctatattattaattttttgatattcgcccggaaacctctttgattttcacgatgatagatcattttgaggtttctttcaatcagatgtgcaaaggtattttgactttaagagcggggtgtttaagaaagttttaacatttttttaatttaatcagaacgttatgttaaattactttaaacacatgttttatgttatacagaaccaaactgttaaagcatattaagcatttttaattttcccgtactattttattctgttattttttaaatgcgattactttatttatttttgctcaaaagatagaaacccgatgtctgaaaacattcaacaaaagatagaacagctccgcaaagagcttcaccagcacaacgaaaactactacctattagatacccctactattacggattatgagtttgatctgcttctgcaggaacttcaggatctggaagcccaatatcccgagttttatgatgaaaactctcctacagtacgtgtaggtggtggtgttaccaaggttttccctacgattcagcataaattcagaatgtactctctggacaattcctacgattttgacgatcttgaagactgggaaaagagaatcatcaaaacgattgacgatccggtagaattcgttgctgagctgaaatacgacggtgcttcaatttctattctttatgaaaacggtaagctttcacaggctgtgacccgtggtgatggtttccagggagatgaaattaccccgaatgtacgtaccatttcagatattcctttgaccttaaagggtgatttcccggctcagttttttatgcgtggcgaaatttatctgaccagaaaaaactttgacaaaatcaataaacttcgtgaggaagaaggtcttgatcccttcatgaatccgagaaatacagccagcggaagcctgaaaatgcaggacagcgctgaggtaagaaagcgcggactttcttctgtactgtatcagtttatttctgatgaagttcctgctgaaagccattgggaactgcttcagaaagcacagagctggggcttcaaaacctctcagcaggccaaattatgtaaaaccatggctgaggtacaggaatttattactttctgggataccgaacgccataatctaccatttgaaattgacggaattgttttaaaagtgaattcactgcaacagcagagacagcttggctatacagcgaaatctccgcgttgggcaatggcatataaattcaaagcagaaaaagtagagacagaacttcagagtgtgtcttatcaggtgggaagaacgggtgctattactcctgttgccaaccttaaacctgttttactggccggaacgatcgtaaaaagagcttcccttcataatgaagatatcattaaaaagctggatcttcatgaacacgatttcgtgtacgtagaaaaaggaggtgaaattattcccaaaattgtaggggtaaacacggataaaagaacggaagaaagcaaagaaattgaatatatcaaacactgccctgaatgtggtactgagctggtaaaaattgaagatcaggccattcatttctgtccgaacgagcttcactgtccaccacaggttgtaggaagaatgatccattacgtttccagaaaagcattgaatattgacaatctgggaagtgaaacaattgaacagctgtacagggagagactgattgaaaatcctgctgatttctatgttttaacgaaagaacagcttcttccgctggaaagaatggctgagaaatctgcccggaacatcatcacaggaattgaaaaatccaaagaagttccttttgaaaaagttttgtacggaatcggaattaagcatgtaggagaaacggttgccaaaaaactggtgaaaaattttccaacgattgaggaattaaaaaacgctaccattgaagaactttgccaggtagaagatatcgggacaaaaattgcagtaagcattgttgatttcttccagaatcctgaaaacatcctgatgatcgagcgattgaaatcttacggagtacagcttgaaaaaggagaaagtaccaatgaagttctatccaatgttctggaaggaaaaactttcctgttcaccggaaaattgtctttatttaccagagaatctgccgaggaaatggtagaaaaacatggcggaaaaaatatttctgcggtttcaaaaaacctcaactatcttgtagtaggtgaaaaagccggaagcaagctgaaaaaagcccaggatattgggacaattacgattctggatgagcagcagtttctggatctgattgagaaataataaaattttaaaatattttcagaaaaagaccattgaaataattcaatggtcttttattattatagaaatgagtcgaattaaataattcctcactttttatcctctctccttccatcccaaacagaaagtatgattaactcagaatttgaaaattcataaaatatcagataatctcttactatttttacccttacattatcaatatctgtctttcttccaatagccgggtgatctgctagtaatcttacattatataagatcagcttattgagttttatactaaaagttttagatttatttcttagcatccaatattcaagaatttcttttctttctttattggctttaacggtccaaattacttttcttttagccattcttctatatcctgattggcctgatcttccgtaagatatgctttattcttatattcttctcttccttcagcaattctttctttttgctcggtagtaagaatatattcattctggtccaattcaaaatccagaatcttctgaatttcttcaattattctggcttcttttaattgggtaattctgttaattaaatcaatttttaaatctgatgtattcatcttatgtgatttaagatcaaatttagaaaaatttatttacttaaaaacaataatagtatatgaagcattttctcctgattttggcagaatcatcctgatatgttctttattcctgtagtaatctatgtaaggttctttggtaatgatctttcctttccctgtttctttatacccggttgccaatatcagtttaagatactgctcatattctttcttctctttaaactcaaattctatcctgtcttctgatttttcttctttatattcaaactttccgattttcgaagtatagtccggggcttcgtattcggttaaaagaaagcctaagccctcagttctgtcataaaatctgaacttcagctgcttcatttcctttttaaactcatccattgtcagtttgttgaaacctttaagctgttctaatgtgaatgtctgagcagaggcctgaatactcaatacaactgaaaataataagagtcctaaagtttttctcatttttatttttatcacaaatataagaataacggtttatgcttctttaagcaacactttccggaacagtaaaatttcttccttgtttaatccttccaaagaaattgtgcgttttgtattaggcatccagtcaggataaagaatcaattccacataattatcatgtatgtgaaactctctgagaacttcaggctttcttgtatttctgcgatctgatccaaatctcagattaatacacttaccaggaacaatgtaaaaatctttaggaaacaaaaacatagaattctgattcatgaaaatttcaaaactacaccattgaaagcttttacgatagctaagacttcctttagtgactgaaacaatggtgccatggatatttttaaaaactaccgcatccggctgtttatatttttcgataattttatttttctggctataaaagaaaattcttgaaatgataaaaaatactacacctgccaatggcaaatagaaaaaaggatccatgaatttaaaaggatagaattacaaatttttaaataagaaaaatcaaatattttcttattcaaagatataacaataactcttatgaaaccggcagtctgaaataaaatgtacttccgttattcagagaactcttcactcctatttctccatgttgtttctcaataaaattctttgaaattgctaatccaagtccggtaccattctgatgctcgccgggaacctgaaaatagcggtcaaagatctgtcggtggtatttttcatcaattccgcttccggtatcaatgatgctgaactgaatgaaagaatccagtttctcaactacaatcttaatactttcgtcctgaaaagaatgctttaccgcattagtcaggaaattattcattacccagaccgttttatcaaaatcagcagtcacagaatcgctgtcttccagaagatattccgtactgatggaaatgtttttctgctctgcaagcttttcaacgttctttacagcagtctgtacgatttcttttggggagcatttttcaacagtcagtctgatatttccggattctacctgggaaagattaagcagctcgcctgttatatccagtaagcgctgcccgtcttcattgatgcttttcagtagttcctgctgctgttcgttcagctctccgaatttttgatttccaagaagctgtacacccattttgatagctgatatcggtgttttcagttcatgggaaatggttgcaataaaattggttttggcaaaatcaagctctttaaaaggagtaatatttcttaacagaattacctttccgatatattttttttccttttcaccagtctttacaatattaatcgggataatgtcctgttcaaaataattttctttgttatcacggacaattttaatcggatcttttaccggatgatcaatatttttcaatagctcacgcatcagatcattattaacagccacttcatgagccgtttttccgataatattttctttatggagattggtaatcttcagcgcctcatcattaatcatgtagataaaatggttctcatccagaccaataaccgcatcatgcatattattaaccagcgtttcgatccgttttttatccatcagctgcttggaaagtgtactgctttcgtattcctgaagtttctctgccatgctgttaaaggaatctgcaagactgttgaattcttcgcttcctttgaaatgcactctttcactatagtttttatcggcaatctgtttgatactgaatgtaagctggttaataggttccgcaatggtttgtggtaaattaaaaagtaatataaaagcaatcagaaaacatacggttcctaaacttacgatccagaaagtcgcattttctgctgtaataatcgcgatatcactctttctttctatgcctttcatattcaaagacataatcttcgccaaatcctcacggatgagtttttctttatggatatccggagctttcagataactgtcaaaatgcaggttcaggttctgcgtggcttctttttctccaaattctgtaaggtttttttcctgaagtttattgtttttctgaaaatcagctattgcaacagtactgtctgtactgatattatccaacgccagaagcatatttttggaaaactccaggctgttataattcgcagtaagaattttttcagtatcggattttaatttattgatatatacagaacctatgactgaaagcagaacaatcagcagaaataaaaggcccacgcctaaggtaagtttcgttttaagtttcattactttttaagataaaataataatatctatctgtttttcattcagtctgttcatcagggtatagatccagctgtatcccaagagccgatgccagaacctggcatgaggcttcccaatacataccgttgtaatattatgggctatcacatattccagaattccgttatgaacgctgctttccttgatgcggactactttggcacctaattcctgtgctaaattaaaattattaatcaaataccgctgcttatccagcgcaattttttcaggattttctgagggtttctgcacatataaaaccgtccacgggctgttataataactggctaaccttgctgttttccgaataatagttttggcaatcttctcgttactgctgatgcaggccagaaattttatcggtttaaaattttcggttttgatctctgtttctacttttctctccacgtgggtggctacttcttttaaagctaactcacgaagctgcaaaatatggccgctttggaagaaattactcagcgcagtctgaattttttcttttttatagatctttccttctttcaaacgggtcagcaattcatcagcggtaaggtcaatatttactacttcgtctgccaatgcaagaattttatccggaacccgctctgctacttccactcccgtgattttttttacctcttcattcaggctttcgatgtgctggatattcatggcactgatgacgttgattccgttatccaaaatttccagcacatcctgccatctttttttatttttagaaccttctacgttggtatgggccagctcgtctactaatacgacttcaggatgttcattgataatggcctgaagatccatttcttcaaggttctttcctttataaaaaaccgattttctttcaatttgcggaataccttctaccagagcttcggtttcttcccgtccatgggtttcgatatagccaatctttacatcaatgccatttcgcaaaagggaatgagcttcctgaagcatacggaaagtctttcccacacctgcactcatcccgatataaattttgaattttccttttcgggacttttgaatcagttctaaaaaatcttttgctgatgacattgatttaattctttttaattttactttaagcactattctctgtgactaaactgatattaaaaccagaccgctaaactcgatgttataaagaaatttccctttttaaattcatcatttttcgcgaaaatagcatcttttgaagtcaaacctctcgcttctgtacggaaaacaacatttttaaatattgcataatctacattcagcgagtatccgaaagtctgaaatccattaggcgtatcagtgctgatgatcactccgtttttatcattataatattccaaccttcctgccagtgcccatttattatccagttgatatttcatctggacattcgggctgtaccagatgttgtactgctcgcttccttttgatttctgttctgcaccgatatcaaatcccaataccgcggaaaactgatccgttatctggaaacttccatataaatcatggaaataacgcattcttttatcctcttttgctttatcatttccaataaacgaactgctgttcagggtaattttatcattgggtttataggttacctggtgaccaaaagaaatactctgatttccctcagtctttgcgatacgctgccatccgttcaataccaatccgcttaaaaaccatttcccattatctgaagtgtaggaaattctggctccggtttcaaaatacggagagttctctgcagctaagcttcttgtcagattcacattatcctttccgatagcactttcccagccaatatgggaaggcataatccctgcatcaatccaaaggtttttatttttagaaattctgattcctacattggcttcattcacgtaccgtaatgcattttgttcagctgccatattatcctgcgcgtaagttccggccattaaagctacattggcacggatattttcgctctgatagctggctttaaccaatcccaggttaagattcatttcattgtgtctgttgtatgagtataaaaaattctggcggatatgattggcaggctcattaaaatcgtaggtataaaacagttctgcataagcggaaaatgtaactttattgcctgtttttaatgagtctgatgactgtgctttggagaaaaacattcccaatacggctcctatgactaaatattttttcacttttattaaggtatgttaaccatgtcaaggtttaaagccccgacatgattatttgattattaatttattattttaatcgatccaaagcaatattaagcttcagaacattcacttttgagggtccgaaaagtcctaaaagcggcttttcagtctgagtattaattaaatttctgatctgttcctctgaaaggtttctcacttttgcaattctcttggcctgatacaatgctccttcttcagaaatatccggatccagcccgcttccacttgctgtaacaagctctacagggactttggtattccccatttcaggattatccattttcaaagtatcgattcttttctgtacaatctccagatattctttattgcttggccctttgttgcttcccccgcttcctgctgcattataattgactgaggaaggacggccgtgaaagtatttctcagatttaaattcctgtccgatattagcataaaacttctgtcctttatcataaataacttctccgtttcctttgttgggaagtattttggatcctccatatacaacggccagataaattcctgttaccaccagcattacaagcgttaatctgaatgctgaaacaatatgatttttcattttttaaattttaatagaataaactgattatcagatcaatgattttgattccgatgaatggaacaataactccgcccagaccatagatcaaaaggtttcttcttaacaatgcacttgctccgattggcttataagctactcctttcagtgccagcggaatcaggaacggaataatcaccgcgttaaaaataactgctgataatatggccgtttccgggctgtgaagattcataatattcaacttctgaagggaaggaataaacgtgataaagagtgcaggaataatcgcaaaatacttcgctacgtcattcgcaatgctgaaagtcgtcagcgttcctcttgtcatcaacagctgcttcccgatttccacaatttcgatcagttttgtagggtcattatccaggtctaccatgtttccggcttctttagcggcttgagttccactgttcatggccacacctacatctgcctgagctaatgccggagcgtcattggttccgtctcccatcattgctacgagcttaccttcctgctgttcctttttgatgtaattcattttatcttcaggtttggcttctgcgataaaatcatctactccagctttttctgcaatgaattttgcagtcagaggattatctccggttaccattaccgtttttacgcccatttttctcaatctctggaaacgttcctgaattccggtcttgatgatatcctgaagttcaataacgccccatactttttcattaacggcaaccactaaaggagttcctccgttttcagaaattttggttaccgcatcctgggtttcctgcgggaagatattcccggctttttcagtcagtttttttatcgtatcgtaagctcccttacgaattcttgtttcttcaaaatcgattcctgaggttcttgtttccgcagtaaaatcgatataggtaggattggaaacaaataaatcttcggtttttaaggcactcagttcaatgatggattttccttccggcgtttcatccgctacagaacttaatgcagaagctttaatgaattcttcaagctgaattccattagcaggatgaaattgggtagccttacggttaccgatggtgattgttccggttttatcaagcagcaggacgtcaatatctcccgcagtttccactgctttaccacttttggtaatcacattcgctctcagcgctctgtccattcccgcaatcccgattgcagaaagcagaccaccgatggttgtcggaataagacaaacgaaaagagatataaatgccgctatggtaatcggagtctgcgcatagtctgcaaaaggctttaaagtgagggtaacaataataaatgtaagcgtgaatcctgctaataatatggttaatgcaatttcgtttggtgtcttttgtcttgatgctccttctacaagggcaatcattttgtccagaaaggattctcccggttttgtggttactttcactttaattctgtctgacaatacttttgtacctccggttacagaacttttatctcctccggcttcgcggatcacaggggcactttctccggtaattgcagattcatcaatagttgccagaccttcaataatctctccatccatcggaatctgatctccagcctcacaaaggaaaatatcacctaatttcatttcagcagacattttgagacttgtttctacctggaaccccggcttgttatcaaggactactctggcgggagtttcttcccttgtttttctgagggtatcagcctgtgcttttcctcttgcctctgcgatagcttctgcaaaattggcaaacagaacggtgaaaaataaaataataaatactaaaaagttataggaaaagcttccctgggttttatcaccggtaagactgaacatgcttacgataaacataacaatggttccgatttcaaccagaaacattaccggatttttaaacataattttcggattcagctttacgaaggactgttttatcgcttcgttaaccaaatctctttgaaataatgtttgtgactgatttttcatttttttgaaagagtttatatcatttaaatcaatagtaaccatcaaggtctgccggattataaggatagatatggataatagtaagtgaacgtttcgtaagtgtcagactagcttccttacacttttcagcttccttaatggttaaatattgattttaatttttaatgttcacatttattttgagaaatactgaatctgttctgcaatagggcctaatgtcaatgcagggaagaaagatagtgctgcaatcagtaaaatcaccgccagggtcataaatccgaaagttgccgtatctgttttcaatgttcctgcactttccgggatatatttcttctgtgccaacagacctgcaatggctactggccctatgatcgggataaatcttgagagtaacagtacaattccggttgagatattccaccatggtgtattgtctcccaatccttcaaatccggatccgttattcgctgcggaagaagtaaactcgtacagcatttcactgaaaccatggaagcccgggttattcaatgtttttgctccaaattccggtagataagctgttaaagctgttcctgcaagaattaagaaaggatggaataaagcgacgatcatagcaattttcatttccttcgcttcaatctttttacccataaattccggagttcttcctaccatcagaccactgatgaataccgccagaatgataaagataaaatagttcaggattccgactccacagcctccgtagaagcaattgatcatcatggcaagcagctcattcatccccgaaagaggcattgtactgtcatgcatcgcattcacagaacctgtagaaattacagtggtggcgatactccaatacccggatgctgcacttccgaagcggatttctttcccttccatagcacccagactcttgtctgcacccatttgggtaatcaaaggatttcctcctgtttcattcactatattcggaatggtaagtgccagaaaaccgaccgtcattaccgtaaagatcacccatgagagttttcttttattcagataaaaaccaagtgcaaataccaacgcaaacggaatgatcatttgagtaaccatttctgtcatattggtcatataattaggattttcaagcggatgtgctgagttggctccgaaaaatccacctccgttggttcccaggtgtttaatggcaacaaatgcagatacaggacctctggaaacgtctgccttctgaccttcaagtgttataatatgatctttcccttcaaaagtcattggacttccattaacagaaaggattaaagtaacaatcacactgatcggaaccaggattctgatcatggattttgtaaaataatcgtagaaattaccaagttctgtacttgtcttttccttaaaagctttgaaaagaacagccatcgcagccattcccgttgcagccgtaacaaactgtaaaaacatcagataaagctggctcagataacttactcctgtttctcctgagtagtgctgtaaattacagttaactaagaatgaaatggtcgtattaaaagccagatcaggtgacatattcggatttccgtcaggatttaaaggaagccacgcctgattcagcaaaagaagaaaaccaatgatgaaccagatcaggttgatcgccagcatggcatacatattctgtttccagttcatctggcgggcaggattaattcccgaaactttataaattaacttttcaacgggttcaaaaaccggatccagaaaagtttttttgtatccgtagacattagctatatatttccctaaaaatattccgataactaatgtgatagcaaacattgctataatgcctaatatttctgtattcatgatggattaaaatttttcaggttttattaaaacataacagatatacacgaaggcaagtattgagaggaaaaataaactccacataatttatattctatcaaaaaattcaactgatttatataaaagccaaaacaatactgcaaaaagcagaattaaacttatcagcatcatatcttaattattaaggttaaaagagtcaataatacatacgatacaatcagcagactaaaagtagagtgctcccgttttttaaacgtttttctagaaattgtcatttttaaatattttattcagagactatatgccaaaagaaagtccatcctgaaaaacaaataattaaaacactgaataacaattaattaaatcaaaacagtcacctatataaaaacagaaaagcctatcaaaatgataggctctttattaaaatgataaaaatttattttaatccatattcttcaagtttccggtacaatgtggcaataccgatctcaagcaaccgggcagcttctgccttgttaccttttgtatattgtaatactttttggatatgtattttttccagtgatctgatacttaatgaatcactttcgggaacagctttttccgagtaatggggaaggctgtctgcgtcaaggatattgttatccatcaaaatcaagctgcgttccacagcatttctcaattctcggatatttcctttccagtcgttgcgctccagcgctttaaaataatcaggatttacctgaacggatgcgagatgaagtttatgggaaaaaatatctataaaatgtttggcaatagctttcagatcttcttttctttcccttagtggcggaagtgtgatctcaaatacattcaatctgaaataaagatcctctctgaaatttccctgctttatttcaccctccagatcccggttggttgcagcaattaacctgaaatcggatttggaaactttggtttctcccattttgataaattctccggtttccagcactctgagcagctttgcctgcaattctatcggcatttcacctatttcatcaagaaacagagttcctccattcgcttcttcaatcaatccttttttatcttttaccgcaccggtaaaagcaccttgtttatgtccgaaaagctcactctccaggatttctttactgaatgcagaacaattgatggctacaaagctgttcttcttcctgtcgctcccctcatgaatggcactggcaaagacttcctttcctgttccggtttctcctgtaagaagtacggctgcatccgtcagagccactttttctgccagctttttagcttgtaaaattagtggtgatttacctatgatctggtcaaatcctttcgttgcagtctgctgaaccactctcgatttattatctttcaccttgtcaagagctttataaaccaatgggattattttctcattatcatctccctttaccaggtaatcataagcaccgttcttcatggcctgtacggcatcagtaatattaccgaatgctgtcatcaaaataatctcaagctgtggatatttgcttttaacagactttaccagatctaccccaaaagcatcaggcaggcggacatcactcagaacaacatcaaattcatattgctccagcatcgtcattgccgaacgtgccgtagaagcttcttttacattaaaattttcctgggaaagaatcatccctaatagtttaaggagtttgatctcatcatcgatgatcagaatgtttcctgacattataattattttagaaaacctatacaaacttattgaaattatttgagtaaaacagggttatacaaggaaatagttagtcaatcatttcatgagtttaaggagctgtttcccgctatccattcatactcctcgcgcctgcatcctcccacgctcaaaccctcccgcactccaactcctgctgcggggtaaccattgctatcggggctaggagtgaatgaatgatgaatgataagatataaatgatgtgacgagattcgggatacaggttctgtggttatcttttcctatgagtaattcattccaatggcgtctttctttttcatttccgctgcttctttctactgtgtcattccgcaggaattcaaccccatcattagagtctttaggattcctttaattcagacaatttgatactgtaaaattttttgatgataattaagacatatggattgcagagactcctgcggagtgacagatgagtgggataaacgatagtagtgaaagcaaagaatgatcggccgtaagaataatagattttagtctgaaccggggtaatgatctttcaattgtgtcataacaatccctttccagttgtgctatggttcaattggcctactctccttcatttgtgccgcttatttccactgtgtcattccgcaggaatccaggctcctttattagagtctttagaactcctttaattcagacaatttgatactgtaaaattttttgatgataattgagacatatggattgccgagactcctgcggagtgacaatggggatgtgatgaatgatgaatgtcaagtgataattgatgcttgataattgataattgattgatgtatcgtttatcatttatcaattattactcattactcattgctcattactcattacccattgcttatacgttcagtataaagcaaaaaaaatcctttatcatttgataaaggatttttaaaaataaaataaaaactggcggcggcctactctcccgcgttagcagtaccatcggcgctggtgggcttaacttctgtgttcggaatgggaacaggtgagctctg

SEQ ID NO: 25 - DNA, 242413 bp, Chryseobacterium sp.
tcaatcctgagccaggatcaaactctccattgtatgtttgtctgactcactcaaagtttttaacgctttagtttttccttacttggttgttatattgtatgtcaatgatctttatatcttccgctttccacgaagcacgctctctgtcagtggcgctccgtatttgcgagtgcaaaagtaaaactttattttttaatgaccaaatgtttttgaagaaaattttaaagttttttaagtaaccttaatccttctcaaaccctcaatccctctactcctgcgctccgatttattcggactgcaaagatacaaactcttttttatctcacaactctttttgcaaaaagttttaaagtttttttcgtctgtctcttgttgaagtaataatgttcctgcttaactaaaagcccttctgcgcttactgttctactctcgttttcagtggggcaaagatagcaacttcctacaacgcaaaacaagtttatttaacataaattttaccgtttcgtaatatttgctcttaaagcactggtaggcagggagaaaaattttaaacatttgtttggggcttgggttggtgggttggagtgtatgagagtttgagagtttgagagtttgagcgggggagaaagagagaatggtgatacgggatgcgggggtgcggggttacagggttgaccattgatcaaaatagtgtatatattatataatagagtccagactatataagaataagaaaacaagctttcttcgacaagttcagaattatacctggttccgattgaattgatgatacaccatattacatatcaaacacagcattgttactccacaggagtccggacaaaacttttcagtagcggctaataccaactgtcaaaaaaaaagattttagacattatcccaccaacttacatcctttaagggctctggtcaagaggtttggattcccgcggaatgacacaatagaaataaaggcttgtactcactaacccgaagctcaaaacacaataacccgaaccactatattctcctaccatgaaattcatcattcatcattcatcattcatcattcattattaaagactccttccctagccctgatagaaatggttaccccgcagcaggagctggagcgcaggagggtttgagcgtgggagagcaaaggcgcgaggagtaaaaatggatagcaggattaagctccataagaaagtgagaatgtggagagtgagagagtttgagtgtgggagagctgaagagtttgaaagtgaaaccttataaagggaaagaaaatcgtaattgctaatcttaacctccttatagtaatggttttctttttatgattcaagttttcaactataagaatagatgtaatattgataaaaagcagctgacattttttttgattccttacatttgtaatccattccggtttctaaggaatgaaatgagttttatatatgacagacagaaaatataaggaaacggttcacacagataaaaaccattacgaatatattacagtaacaaacgacgaaaataacgtcagaatctatactttgaagaatggattaaaggtttttctcgctcagaattttgatgctccgagaatacaaacctttattccggtaagaacaggaagtaataatgaccctgccgataatactgggctagctcattatctggaacatatgatgtttaaagggacttccaaaataggaacccagaactgggaaaaagaaaaggaacttcttgatcagatttctgcattatatgaagaacataaggcagaacagaatcctgagaagaaaaaggaaatctacaaaaagatagatgaaatctcacaggaagccagtcagtacgccattgccaatgagtatgacaaggcaatttcttctctgggagcaagtggaacaaatgcgcatacctggtttgatgaaacggtttacaaaaacaatattccaaacaatgagcttgagaaatggctgaaaatagaaaaggaaagattctctgaaattgtccttcgtcttttccatactgagctggagtcggtatacgaagaattcaacagagcacaggacaatgatacaagacttgtaagctatgagctgatggatgctctttttcctactcatcctaatggacagcaaaccacccttggaaaaccggaacatctgaaaaatccttcaatgaaagctattcacaagtactttgatgaatattatgttcctaataattatgccatggtactggtgggagatcttgattttgaaaaaacgattcagttgattgatcagtatttcggtactttaccttataaagaacttcctaaaaagaaccctgttactgaacaacctctaacagaaattgtcacaagaacagtaaaaagccctactactccacggactcagattgcatggagaacggaaagctatgggacaagagaagctatgctggccgatattacagccaatatactcagcaacagaggggaagccggattattggatttacatatcaatcaaacgcagaaaatgctatgggcacaggcattttctgttggattaagacagtacggctacttttccatcgttgctgttcctaaggaaacacaaacgctggaggaagcaaagaatatggtacttgatgaaattgaactgatcaaaaaaggagattttccggattggatgctacctgctatcatcaatgatttcaagcttcagagaatgaaggggcttgaaaccgcagaaggactcgctactacgctttatgactcttatataaaaggaagaacctgggaacaggaactgaatgaaatggatgaatacgcctctttcaccaaggaggatgtagtaaattttgccaatgattttttcagagaaaactatgtggtaatcaataaagaaaaaggagtaaatgataagttgatcagagttgagaaccccggcatcactcctgttaagattaaccgtgatacccagtctgagtttttaaaagagattttagcggataaaactgaggatattaagcctgaatttatcgattatcagaaagaaatcatcactgatcagctgaatggcaaaaaattaagttttgtaaagaacagatacaacgatatcgcacagctgcattttatttttcctatgggaagtgatcatgacagagatttaggaatttccactcaactacttcagtatttgggaacagatacgctttcgccggaagatctgaaaaaggagtttttcaaaataggaatcagcaatgattttaaaacaacgaatgatcagctgaccatatctttaagcggactggaagagaatatagaaaaaggagttgccctacttcagcactggatgcatgatgtaaaacctgatcaggagatctataaccaatttgtaggaacagtactggaaaaccgccaggctgtcaagaaagacaaaaaccgtattataacagccctgaacaactatacaaaattaggaagcaattcacgttttacggatgttatttcgaaggaagaacttgaaaacagcaatgcggaagtttttactgacagaatgaaaaagctattcaaatatccttaccaggtatttttctatggtaaagactttgaaaatttcaaggaatatatcggaaggtatgtagaacctgaaagtcttcagatccctgatgccagggaatatcctgaacctgcgacaggaggaaacgtcaatttcatcaattatgatatggttcagatggaaatgagtaagatcgggaaaggaaatgaggtgaaccctaatcattttggaaagatcaatgtatttaatgaatatttcggaagaggattgtcttcgattgtattccaggagatccgtgaaagtaaaagtctcgcctattcagcgtatgtttcctatgcagcgaattctgagcttaaccatcctgactacgtgactacttatatcggaacccagccggacaaactgatgattgcggtggataccctgaatgaactgatgacagaacttcctgaagtacctattcagtttgaaaatgcaaagaatgcagccctgaaacagattgcttcaacaagagttacccgaaacaatatatttttcaacactttaagattgagaaagcttaatatttatcatgatttcagaaaggatatttatcagcagatccaaagcctgaaatttgaagatatcaaacatttctatcacacagaaatcaaaccggtgcagtttaatacagccattatcgggaaaaaagaaaatctggatatggaagccgtcaataaaatgggaacatttaaagaagtaagtctgaaagatattttcggacattaaaaaaacaacgcctgataaatcttttcaggcgtttgtttttttataaatgatgaatgatcattgatatgtgataatgccttattctacttacgtcatcatacaatctccatcgccatcctgatagtttgggttaaaattatcgggtaataatgccaaaaggttcttatggaaaagatactctcttctgaaatcacgctcgtagatatgggaaaatacttttgagttttgtatggctttgtttaatccggtttgataagaggtgaagcctttcactttatgggtaatgatgaagtaatttaaaaaacggacaacctcatctggattactatccgtaaaaagataaggtattttaagatagccatcacggagctgcaacagaaaacaagatgtaagtttattggtttgatcaaaaattttaatccagaagtatttaaatgtcccggcaaaactcgaaaaaaagtatttgtcatctttttcgccttccagcacccagggattgtctataaagatgttaatttcatccgcattacgcctgttaggaaatccattaatgaaaacagcactttcctgatcgattctatccagcatttcatatttgaaatccggtttttgtgtggaaagattttttattgagatcagtccattggctgtaacatccagaatttttaaaagtggcttcagggattgcgttcccggctttttttcaggaatcattttagcagcatctgttctgaaataatagcgctttccttctttaggaaaagcatactcaaacactcccataatattgtaaagtgcctctgcttctttggtaaattctgtaatggcaattcttccttcgtactcttcaaaaacttttttcaataatgcttttgccggtcttttctttctgtattccggattcacatacagcgtactgagccaggcatagtggattttttttccatcaatttcaaaatgatccggaaaacaccccacataacccaccagtttttcttcatagaaagccagaataagaagagtgtcttcagctaatgcttttggattctggatatgagacaacgcacggtgcctggtaaccggaagaaaatcatattgctgaaaatctccggaggatataaaatctcccagttcttttctgttgtatgttttcagtgttatcattttctcagaatcatatttttattgatcagctttttcagcctgaaataagcaatttcctttttcaatatctgtgctccgctctctcccatttccatcggaattctttgaaaatttttccttacactgtccagctttatgccggcacatccgaagctgcagtaaatttcttcatttttatagagttcatcaaaaaaatctttcttgacttcaaaatcggtaaacgggaatgcaaaactttcgtacaaaaaaccattttcttttacataagcaaaagctttatctgttgtttccatctgttctttcagagataaatctccgtatttcgggtggtcccagctgtgcgatgagattccaaagcctttgcgggtaagatcttttaattcttcagtactcaaataaggcttatattctttggagtaagctttaaaatctatttcaagtttttcagcaagcctgtccagaatacttttttcctgataattaacggataaaattttcttttgtagaacgcgtctatctatgttttttaacgatagaataaaataaatttcaggatctattgttttcattcttttagcagcatcggcaagaaggcttgccttacacctgaacatcatctctttgttatcaatgaaagcaggattgataaaattacaggcataaattccttttcgttccaaaacaggagccgcaatatcataaaactctctgaaaccgtcatcaaaagtaagcaaagcaatcttttttgcaggcttaaaatttcctgacatacaatctttgaactcctgccagtttacaaactgaaaattctttgagagatgatccagatcttcttcaaacagcctggtattcttataacggattatgtgttttaaatgaggaagttccctgtctgagacactatgataaagaggcagacagtaatccagcggaaaagatttcccgatattctcagatccgagggctgccagtacattgatgatcctgtctttcatcttatttaaaataaaaagaatctattcaaaactcaattcaaatagattcttaaaggtataacttttaaattattttataattttcatttcatcaataagccactttgagtcagcaaacttatcaatgatgaaaaggatatatttcgtgtctaccatgatgtttctgctgaaacgcggatcatagttgatatcactcatagtaccttcccactgtctgtcgaagttcagtccgacaaggtttccgttggcatccagagcaggacttcctgagttccctccggttgtatggttggttgcagtgaatcctacaggaacatcacctgttttatctttataaattccgtagtcttttttgttgtaaagatcaatcagtttctttggaacatcaaattcataatctccaggaacatatttttccattactcctgccaggtgagtctggtatccgtacgatacggcatctcttggcgtagagcctttcactttaccataagtcacacgaagcgttgaattggcatccgggaagaactttctgtccttatccgtctgcatctgctgagccatgaacgttttctgtaaagcatcgatttttgcctgcattgaagtatattgaggatctgcagttttcatataggtttccttcatggcaacatacagctgataaatcgggtctttctttaaagtcttgatcaatttatcctgattggaaaacgctttatcaatatctgttgtcaaagttgctccgtttacagcagttcttcctgtgacaacggagtttttagacatatcttccactacaggaatgttggcattttcatctttatatttgttgaatccagccggtaaaaactgtggtgctgttttgttaacatataatgccagtaattttgctgttactttagcatcaagctctgcactgtagtctttgtaaaaagaagttaattttgattttaattttgtaagctccttttcatccattcttccggcttccacagcagctacgaaatcataatagtctcccgcaagctttaaagtctctgcatttctggttacttctgtatagtaagcattgtttaatgcataaggagcctgatcattgtacagtttattcagctgatccaaagtattcttgatctcagggtttttagccaccaaagatccttcgtacattactttcttttctacagcattggattttttcaatccttctacttcaccaatccactttttccagtaattggctactgaagcatattttgaagcgtatttgatacgtgtttcattatcaacacgcattttctcatctaatgtttttaaagccacatcacgtacggcaatcttagcaggatcaatatctttcatgatcttttctaccgcaacggcaggaaggtattccgtagttcttcccgggaatccgaatacaaaggtaaaatcgttttcgtttttatcttttatggaaaccggcaagtagtgcttaggtacgtaaggtacgttgtcttttgaataatccgcaggtttgttgtttttgtctgcatagattctgaacatagagaaatctccggtatgtcttggccaaacccagttgtccgtatcacttccgaatttcccgatactttgaggcggtgctcctacaagcctgatatctttatacgtttcgatggtataagcatagtatttgtttccgtaatacataggctttatcatgatcgactggtaagattcaattttctgagcgtttttatatacctcaatattattattgatctttttggtaagttccggttctgtaagattgtccgtaccttccaaaatatgatccgtaacttcttttatatctacaataaaatctacttttagtccgggattagaaagttccccttctgtattttttgcccagaaaccgtttgaaagaagatcattctgaacggtagagtgcgcctgaatctggccgaaaccgcagtgatgattggttaacagcaatcctttcggtgaaataatttccgcagtacatccgccgttaaactgtactactgcatccttaatgctcggtttctgagggttgaaaatatctttagcagaaatcttcattcccaaatccttcatttccttttcattcagctctgtaggaatccacattcctccatattgttgtgcaaatgccattgcagctggcaaaagaaatacagataaaagtatcttttttgtcataatcaaaattttgccccaatttacgaagaaaaatatgaacaggctttataaaacaggtggaaaagttattaagaataggtttttgaaaataaggacagtccatagtgaattttgcttcgcaagtgaatagtaaatttttataatcaaccgataagtaatttcattaagaattgacaagcaagcgaattgtctatgcaccattccttagaggtgatgttgaatgctcttctggctcagtttttgttgattggaagtatctttattattaaaaacatacttaaatctattattatgatgaaaagcaaaatgctcatcttgggaatgggagccgctctgttccttgcctcatgttctaaaaaggaaacaactgaaacaacagcaacaacagattctgctgcggctgttcaacctaccgcaacagacagtatcacaaaagcaactccaactgctgccggagatacttcagagaatgcactggactgggccggaacttatgaagccactgttccatgtgccgactgcccgggaatcaaaacttctttaacgttgaataatgataaaacattcagcattacggaagaatatcttgaaagaaactctaaaaatcaggataaaggatcttttacatgggatgcaacaggaagcataatcactttaaaaggaaaatcggcaaactataaatataaagtgggtgaaaatatgttgatccagcttgatatggaaggaaaggaaatagacggtccgaacaaggatctttatgtattcaagaaaaaataaaaataaaggctccggcctttatttttttgttcttatagtctagaactgataagcagtaattttagaatcatttaccagacgccgtattacttcttcatggtgactgttttttcctaccagcctccagacaacagtaaaattgtcctgtgaatattgttgcctgatcatctggtatcttaaatgatgttctttaaagatattctcgcaatagctgatatcttctgcctttgttacagcaattctatattcccttactttattataatcatcaataaaattctgaagataggttaaagcactcagaacgataagtaccaaagcagttcccagcatagcaatataaacatatcctgaaccaactgccattcctatagaagctgtagcccaaatggttgttgcagtcgtaataccttcaattttattatctcctttaaaaatgactcctgctcccaggaatccgattccggtaatgatattggcagcaaggcggtccgggttttcaactcctatctttatagaaagaatggtaaaaagacaggctccaaaacacacgagaataaatgttctgagaccggcagatttattccggtattcccgctcagcaccaatgaacagtcccagaataacagaaataagaatcagcagtaattcatttttgacaatataatggtcctgaaggaaatccatagcttttaatttaaaccaggaataaatttacaataaaatacaattaaagaactacttttgccactcggattttgtcttgtacattaaaaaaatatttcacgaaaaacttttgtaatattacaccttaacagcaacaattcctgaaataaaaaattatgaaggtaatcaacggcaaattcgctcaaaaaagatcaaaaaataatacttatatacattatggataaagaaatttcacacttctggttaggatattttaaaaatgaagaagacttttacagtttcgtggaagaagacgaaaattattatatcgaagaggaaagcgaagatcagtacgtttccaagtttgcagaatcacagaatatcaaatggtttgatgatgattttatagaatatggcttcgaggatgaaagcctaagtctttatgacaagtttgcagaatattcttatgctgaccaatggctcccgatcctggaaagaaaactgaatgaattaagcctggatactcctgtgaatgccattattttcgccacaagatttgtaattcccaatcctgcttctgtggaaaatgatgatttttcactgcattatgtgggggaaatagaatatgatatttaatatcagagaccaatctgctcaataattgctggcaacaagtgattttattatactgatcatctgttgccattttttaatcaataaaaatgaagataataaagctatatatttgaatcatgaaagaatctaaatctaagcagttctactcttttctgaagagatggtttgttagtactgcttttatttcattgattacattcttacaattttactggtcaatgggaaccttttcagaccgtatttcaagcggctgtccggagtgttcattttttgaagatgcggtatttatatcccttataaccggtagctttttatcaattgtcttttctctgtttttttttgttaagagaatcatccttagggcttctgttgagttcttattactgatcttggtttggttattttggaactacaccatatttgtagacagagaatcttcctggagcacttacgacgtcacttcggaaattcaatatactgtttcgctttcctatctttctgttatcttgctgggatgtttgtgtatttggatcttacattatcaggaaataaaagctagatttgtattttgtaaaaataaacaccattgaaaaaaaacatttctattttacttttagcttctttaattgcttattcatgtaataaaacccaaacagatcctccgaaatcctctaaagcctttataaaaaaggatacaacacaagctcagaaggaggaatcagcagcaggaaaacaaatcccggattttgtttcaaatcaatatgaaattcaatacgaaaccgaaggtgacctcaaccaggacggatttcccgataaggctttagttctaaggaagaaagacgacactttagcacagagaacaatgattgtccttttaaagaatcctgacaaaacctaccgcttatataaaacttccaaaacagtcctgcccgccgaatacaatgattcaggttataagatgcatgatcctgaagacatcagtattgagaaaggggaattacatatcaatttatatgacatcgggccttacggcaaccagttcagtacattcaaatatatgaatgacaacaatctggttctcacttatatcgaaacctataatatgggagcgggttctcattctgccctctattacgaaccaatgaaaggtaaagtaacgcttgaaacggtaaatactatggaagaagaaatgccgtcagaaactaaaaaggtaatcttgaagaaagaaagattcttatttgaaaacgtttctcctgatcatgttgttaccaatgtttaccattctgtagaacagcaggagtaagctgtcccgatctaataaaataaaacttccgtctccaggacggaagttttttatgtaaggtactatttttagtctgattaatgggcttccagccaattatcccctactccaatctccaccaataacggaacctgtgtttttaaggcattttccatttctgttttgatcagctgggaagcagattcaatttcatccgccggggcttcaaacaccaattcgtcatggacctgaagaagcatttttgttttcagctgctgctcttccagttccctgtcaattttaatcatagcaatcttaacaatatctgctgcacttccctgaactggtgcatttacagcatttctttcagcatggcctcttaccacaaagttgtttgaattgatatctttcaaatgacgttttcttcctaatattgtttctacatagcctaactgacgtgctttattcacctgttctgccatgtattccttcaacttcggataagtctcgaagtaggcttcgatcatctgcttggcttctgtacgggataacccggtttgctctgccaatgcaaaagccccctgtccgtagatgatcccaaagttaacggttttggcctggcttctctgggttttggaaacttcagctaatggaattttaaacagttttgcggctgtggaagcgtgaatatcctctccatcctggaaggctttgatcatgttttcttctcctgaaatttcagcaatcagacgaagttcaatctgagaataatcggcagagataatctttttcccttctccggaaacgaaagctccacgaatctgctgtcctctcagcgttcggatcgggatattctgcaggttcgggtttacactcgccaaacggcctgttgcggctgtagtctgtgagaaattggtatgtaccctgttgtcgtctttatcgatctgcgacggtaaggcatctacataggttgatttcaatttctggtaagttctgtactccagaatatgtttgatgatctcatgttttgaagaaagtttctgaagaacatcttccgaggttgcatactgcccggtctttgttttcttggcttttggatcaagctgcattttttcaaacaggatttctcccagctgccttggtgaattcatgttgaactcttcgcctgaaagttcaaagatttttgcttctaatcctttcaggtcgttttcaagatctacactttcctgtgccagccatttttcatccagggaaataccagccagctccattttggcaagtacttccatcagaggcatttcgatattgtagaaaagttcttccaggttttcttttttaagctgtggtgcaaaaagttcatacaactggaatgttacatctgcatcttcggccgcataatcggtctgggttctgagatctgcatctctgaaattcccttgttttttacctttttttccaatgatggtttcaatggatacaggcttgtagttcaggtacacttcggaaagataatccatcccgtgtcttccgtccggattcagcagataatgggcaatcatggtatcaaacatggcccctttcaccgtaatatcgtattgttttaagactttataatcaaatttgagattgtgtgctactttcagcaggttttctttttcaaaaaacggtctgaaaatctccagggtctgcaacacttcttctctgttttcagagagaggaatgtagtaggcaagtccttttttataagagaaactcattcctaccaattcagcttccagctcgttcaatgaggtggtttccgtatcaaaacaaaccactttttgctgtaaaagattatctacaagttttttctgagctttcggattattgataaactgatacagatgatcgttatgctcaatagttgattttgtagaagtagcctgctctaactcttcaaaattagcaaaaagatcaagctgcattacctgtcccttgacttctgttccggccggagtctgttttacttctacctcgcttacgacaatagtttctgccggcgcaggagcaaaagctctgtaaaggttttcgtacagccttctgaattctatttcatcaaaaacttcttttactttttcaaaatccggagtttcaagatcatattgttcctggtggaattctacgggagcatcacagataatggttgccagttttttagacaaaattccacgttctgcagaggcttctactttttccttcagtttacctttcagcttatcagtattggctaacaggttttcaatgcttccgaattctttaaggaacttcatcgccgttttttctcctactccctccagtcccggaatattatctaccgcatctcccatcatggcaagaaaatcaataacctgtttagggtcttcaatttcatattttgcctttacttcttctactccgagaatttcgatatcacctccttttaaacctggcttataaattttaattttatcggtaaccagctgtgcaaagtccttatcaggtgtcaccatatacgtggtatatccttctttttctgctttacaggcaatagtacctatgacatcgtccgcttcatatccttctactccaagaataggaatatgcattgcctccagaattctgtggatgtatggaacagcaattttgattgcttcgggagtttcgcttctgttggctttataatcagagaaatcatcagttcttacgctagcttgtcctacgtcaaaaactacagccagatgagtaggtttttctctcctgatcaattcgatcaaagaattggtaaaaccaaaaatagcagaagtatccagccctttgctggtgagtctcggattcctgattaatgcgtaatatcctctgaaaatcatcgcatacgcatcgatgagaaacagccttttatcttgtgttgcgtccatattatctataatgaacaaatataagaaaataggagtaaaagttgatagtttgaggaagagtttcaggaatgagattggggtttcggggatatgggatacgaggtgcgggatgcgggatacgtattatggtaaccactttttagcaattattgttttgaaatggaattgttcattcttatctcgatggctttccatttttattattttaacaaccactttttataaaaataaaacagcatatccaaagacatgctgtttctttttttatttaagtttatgggattatttaccagatgtaggccatagccctgcgtactgagaattaccgtagtcaatagtttcagcacttactacgaagctgatcagcatactgttgctgtcaatggcatcaaagtctacttcgtgctggattacatatccgttttcccatttcaaagtaattaatgttccttcttcgtgagatttattgaatgtgatttctcctactgtaggcttatatttaccgtttaacaagctttcaaggatgtctgatttttcagtagcttctaccgtaaccttgattaatgcattggaaggatccgatgctacacgtcctgatacgtctgtagatcttgatacactgtagttcatttttaacagcttctgtccttctccgttgttgaattttaagattcctcttgaatttctttcggccatgattgtaaattttaatcgttagtaataaattgtaattcaataattatataacaaagataaaacccttgtttttgaaaaaaaagcatttgaatctaaatctgaaaaagtgtcgtaattgtacgatttgatgtcgtagttctacgatttattgtcgtaattctacgacaacagatttaaaaacagaacataaacaccttattacaaacatattaaaagcaaaaacagagaagttattactacactataaagagatatattacctctgaaattatcctcaaaatctgataatgttaaataaaaaacagaacagcgtctcttgcccgctgttctgtaccaattttatttttactaagatgatgaataggcttatttacctgctgaaggccatagtcctgcgtactgagaagtaccgtagtcaatagtttcagcacttactacgaagctgatcagcatactgttgctgtcaatagcatcaaagtctacttcgtgctggattacatatccgttttcccatttcaaagtaattaatgttccttcttcgtgagatttgttgaatacaatttcccctactgtcggcttatatttaccgtttaacaaactttcaaggatgtctgatttttcagtagcttctaccgtaaccttgattaatgcgttggaaggatccgatgctacacgtcctgatacgtcagtagatcttgatacgctgtaattcatttttaacagcttttgtccttctccgttgttgaattttaagattcctcttgaatttctttcggccatgattgtaaattttaatcgttaatattttgtgattcggtgattgtgttaacaaatatagaggctctttaccgctaaaaaaaacttttcaatataaatctgaaaaagtgtagtagttctacgatttgttgtcgtaattctacgacattagatttatatacaacattaacattctgtttataagtgtattatataaattaaacaagaattataaaattaaaatatttcacactaaaaagacaattaacatacggaaaatcatattattaaccctttattatgttattttcctttaattctgtttaaatcctcctgataaagattttctccgtaattgttcttaaaatttactgatcgtttatctttagaacttaacgactcatattgttttattctgagttttgcttcttccaatgtgtccttcttatatggaaatgctatattatatttctcagacagctgttttttaattctgaataatttttcataataaggagagtcgggcaggttacgatcatttttctgcttttccttatactgaatataatctgcgatcgggcaaaggttcgttcctttaattttaggcaatcctcctttagttaaaaaatattctgccatatccagatcgtctctggcagcactttccataatattgcttccattataggagacattattgatgtcagctccattctgaagtaagtaatcaatcattttcttttcggtactttcatcacctccgagggtcatcgcatcagataagggggaattccctaaagccgggttaggactggctttatatttaaaaagcaactgcagcatttcataattattaagtgctacagcatgattcaaaggagattcaagaccttcatgcggcactatgatattgggatctgccccaagttccaaaagcttttccattgcttttaaatcttcaataatggaagcatacatcagtaaggtataacctgtattctcctgcagtttattgatgtcaatatttttttccttaatgagctcttccatgcctttaagatctccatcaaacattttctgggctgctgataaagcgtctccggcaaacattctcgaaggaggatattgatttctattttcgtttttacgcgacctaagattaaaatctgaacaggaaaaaagtgtcatgatggaaaatattattaaaataattggtttcatattatatattattagctacaacatcagtatttatagtggccagcattgcctggaacgcatcattatatgcgctatgaccgcttccaatggttttgattccaagcccttcattatcatcaatatacccgaagatttcatgctgttgtcctaaagcccttggaactcctcccgtgaggcctccaaaaattgcaattttgttaagccccggaattctggataaagccaatgtagaaagcaggccttctctgttattttgcagcccgttaagaatatcattacttgtactgtaattgataatgtttgaagttgattttacagctccttttttatcgagataatcaagtgtattgccatgtactcctcttgcattgaaggtatatcccggaagaccggtataataggaagccatggcgctgtttcctcctcccaatgaatgtccggtgaatttcacttttcctccggtagcattatccattttttcagcgagcattctggttttttctatctgaggggttgcaaagccaagagcctgccctccatcttcaataagccagtcatgataaaactgcattcctttaggttcggagcccctgaatgctacaaaataatctcctgtttctttgttataatataaggaggaaaagaaaccgttatctttattagtgttgaaatctttgctgtttagcactccgggaccgaacagcttatccagctcagcctgatcatctgtattgattcttgtatatccttcaatattggtattcttcccgttatcctcgtaagaatcctgggccattctactggcaatagaggcttcctgtaactgggcaacgggcaaatgaaaggtaattttacctcctatgaaacagtgtaaactggaattttgcaacagaggttttttattttcaatttttactttgggatgggtattttgccagtcgcttcccttgcataaaaaggaacagatattaaggcagtcatctatgagagcacttcctgcccaggccgcggctgccaaaacaaaaagccctccggagaaagctgctgctactgccacacctgctaatgctcctgccatcatcatttcgggacaaataaaattatctttaaaccgatccttttccgtagccatcagcttagctccttttttcaattttactgaagactgagagctgactccaatgcctataagtctccggcctttactacaagtaagcggagtatcctgtgcgatatataattgactcatagtgacggtattaattgttattttttatttaactttatcttgtatctgcaaacatagatcatcttttcattgagttcttctttcacatggaatataacttctgataatacagaatcttcattataagtatactcaccttcaatggtgtacttatattccagagcatttccaagtgttctctgatatttatctttataaatactttcaaaacgggactggttccctttacttttgccatccagtttgactatgaaacctccttctttattttttaaaattttgtacgaggaactatattcaagttcttctcccgggaaaagggttgacaaagttgttcttgcaggaatttcatctgtaaaacttcctccgctgaatacgggtaaaggataaaacatgatctgatacaaaaaatttcgactgatattgcgatctatattgttaaattcctgatcatagatctgaataaatgccttgtaactttcttttaccagttcaaaaaaatgcagatccttttttatctcttcccacctgcgtagaatttcatttttattggtgacttcatgaatacttttatcggtatttaaagatagttcaacaacttctgttgctttgtttattttctcaagaatttcataaaacggctgcatttgtccgtctgcctgaatatatctctgggtagaagaatggatgttaatatgattgtattctccaggtgttacgatccagtcttcttctatttctgtctggttagctttacctgttcccagtgtaagataggatttgatattgatgtgatattctccttttttataccaggcatatttaaatcctgacagatggtcatttttttcagctttattcggttccaaagtcatgtttttaatacgttttagaatacactcacgatattagttgatatcaacattacttccagtaataaatatatctcctgtagcattcattgaagtgactgctttactgtgaatactcagattatcctgtgttaccaataatgcatttttcaatgaattcaaatccagcattccttcttttgcagatatagtaatgccttctttagtaattgtgatactgttttgacctacccttaattcaatttttgtttttccttccagagaaatatttccgtctgcgtccattgtcagaacagaattggctgccccgccttcttttcctccgacattaatggaatttgtactgccggcatttaccgtattattacttcctacgtttaccgttttattgttattggcattagtctgaacatttcctgccccatcaaacttcatattggctccgccctgatcagtaagaaatacagaaccttcaccatcatttaattctaatttatttccacttctgctgctcaggctttttatattgttaccggttccgccaccgccgccgattccaccatggaacattcctcccatcacaaacggacgatccggatgctgatgtacaaagttgacaataacctggtctcccacttccggaacagccataaatcctctgttcttacttactttatcactactcccggcatccggagtcattacgcggataaattcggtagtatcgggtccgttttgccaatcgaactgcacccgtactcttccctggtttaaaggatctgtatttgaaattacttttccaaactgggcttctgcttttggcatctgaaattcgggacgcgggataaatcctgtatctgcggcaattgcttcaaatttaccatcgtaatagcctctggcatctacttcgtgagtgacttcaataatcatcagcttggtaaaataagccgtttcattactcccggatttgcgcatttcgatatctgcggtacatcccgggtataagaaaggaactgttgtagttcctgaagtaacgaaaacttctgaagctttgcttcctgcggttcccttctgggaagcatcaatatccatgaaggaagaagctttgataggagcaactctcagagaaggggttgtaaaagttttttctgatatttcgtaagctcgtcttgcaatatctgatgtatggttaatttttgaactgccagttgtcagcttctcatttttactgctgttatagccataaaaagtaggacttacatgctgggccttcattttgatggcaatatcacttacactgcttccataagtaagccttacaggcttttcctgaggtggcaattttccgaagtgcagaacttccccatcataataaaactgctctccataggcttcggccattctggcgagatagttataatgggtttcttcatattgtgagctataggatatatttccatgttgtgcatctactctgaaatcgaatttatgctgtcccagtccttctttaattacctgatcagcaatactgttcagacttacaggctggcttcctccaaagctctgaatatgaggagcagcatctaaaagtacagttgggctgtagcctttgatcataatatttccaagacttcctttttcctggctgaatcccacttctgtaatcactcctacaaaattgcgttcagcacctttctcaatatctttatatttgaaaacaactgtgattctttttcctaaaaatctctgagcttcttccagattgtgattttccggtttacccaaagtatcatgggccagcatcagactgaattcatggtgcctggtagcactctggaccagcttaaaatgcttgaaatgattaatgatctgtccttctatgatgacatcgagcttgatgacacggttgattccagctatataactctgagaaatagcttctgcattatgtatttttgaagtaggctgcctggcccacacttttgtctcaacaacggaaggatcattggaaaccaacgtttgattcagaaacttacctgtttcctgtgctgagtttacatgctgtgcggtttctgctgtcttttttattttatcccctgctttgcttactttttcctctgctttcgcaaccgcattttcctgtgcagtttttttgatcgtctctgtatcctggctgatagattgttgagaattctttattttggttttatcatcttgaaacatagtgttgcgtgtttaagttaataaatattgaattgaagctgtaggtattattaccagctctttaaattccagatatcgttttctatgtactggattatttatctgaaacttattgtaaagcagaaaacagaacagcaaacttttacaagggctgttctgtaccaattttatttttactaagatgatgaataggcttatttacctgctgaaggccatagtcctgcgtactgagaagtaccgtagtcaatagtttcagcacttactacgaagctgatcagcatactgttgctgtcgatggcatcaaagtctacttcgtgctggattacatatccgttctcccatttcaaagtaattaatgttccttcttcgtgagatttgttgaatacaatttcccctactgtcggcttgtatttaccgtttaacaagctttcaaggatgtctgatttttcagtagcttctaccgtaaccttgattaatgcgttggaaggatctgatgctacacgtcctgatacgtctgtagatcttgatacactgtagttcatttttaacagcttctgtccttctccgttgttgaattttaagattcctcttgaatttctttcggccatgattgtaaattttaatcgttaatattttgtgattcggtgattgtgttaacaaagatagaggctctttaccgctaaaaaaaacttttcaatataaatctgaaaaagtgtagtagttctacgatttgttgtcgtaattctacgacattggatttaacaaattcattacacatacgattaataaagactttcaacacatttaaaaaggataattaaaatcaataattttacacattactgagaaatattaagattcttttaataaaattagtatgtttttaacagtacaaaaaagcagcaagtaagaaacctgctgcttatttattttattcaattttatttactgtttactgttgagtcttacctccttcttttatggaacgaactaatattttattttttctcagcagaaaatcgggcatcagatcaaccggaagatagaaagggctttccccttttttctgcagttcttctacaattcccggattccaggcaagaattttatctactcctatattaagttcggctgcaactacgttaagattaaatccggcattgatttctgtttctgaaagtgcagcagcagtttctttccggtctccttcaaaaaacaccttattgattcttgatgaattataattattcaggacactctgaagctctccggtagcataacatgcattcaggtatttctttacgtgattaatagtttcccccggaagatatttataaaattcatgatattgagaggaacctgcagcttccattgctttcgctatatttccttcgccacagttgtaagcagctactaccgtcacccaattattatactttttatagaggttgcttaaagaaatggccgctgttttggtacttttatagagatccgtacgtccctgctcagtaagtccgtactggttggcgtgtgcagtcataaactgccaaacccctacagctccggctcctgaggtaatatttctgtcaaaattagactcaatcagagccaggtttctcaaatgtttgggaagtcctttctggagaagtaactgctcaataaattctaccagatctttattggcattaatgatacttctgtactttttcacactgctttccgaggtatcggaagcggcaagaaactgtccgtttaccaaaacaacagttcctattaatagtaaacctgtaaagatatttctgacaatcgttttcatgttaattttatttataagcaaaaggcaaaaaagcggcttgcagatctgcctttactgtatacttaatctactttccagcttagtttttcttcttctttattccaatctacatggatagtctgcccggatttcacttcttctctgacaatcattttagagataggtcttgccagctgtgcacgaatgactccagagatctgtcttgctccgtacttactgctgaatccacctaaagcaaggtttctgacagcatcatcacttatttttaaagtgataccgagccttgtcaaggatgtatgaagtgatttcagctgaatattaaagattctctctgcaatggattctgtaattggtgcaaaaggaatgatctctgtaattcttgccaggaactcaggtctgaaccgtcctgaatttgacataatttgcatcagtgaagatgattccggaatttttccttcttcaaactgttttacaatttcttcacttccgatattggaagtaaacagaatcaatgcattactaaaatctccttctttccctaatttatcatgtactttcccttcatccataatctgaaggaatacatcaaacacagaatggtgggctttttcaatttcatcaaataaaactacagtataaggctgttgtctgattttatttaccagcatacccccttcttcatatcctacatatcccggaggcgctccgtatagcaatgccgcggaatgctcttctttaaattctgacatatcaaagcgtaccattgccttttcatcgttgaaaagcaactctgccattgatttcgccagctctgttttaccggttccggtaggccccagaaggaagaaggatccgataggttgccccggcttattcaatccgcttcggttttcaacaatggcatcggaaaggattttcaatgcatggtcctgccctaccactctgttcaacagaagggattccatattcaggagtttttctttttcctgggcctggattttcccgattggaatattggtttttgcagccattacagcagccagttctaatctgtctaccttttctctttttttggccgcatgctgcagaagttctgcataggtatcttcaataatcttctggatctgatctacgggcatagagttgtcaatcgaaggctgttcactcagtgatccccacagaatcgggcttattttgtctctcaacaggttgtaagtccagatcagttcatccgctttatctttgttgtctgcatattcttccttcaaaattgtatcataactttctttccagctttcaagttctttttcggaaagttcatcaagcattttgatcgcggccattgttctgtctaacaaatcgatagctgcatccggcaattttttacctttagcatatctttttgcaagacgtacgcattccggaagagctgttttttcaacttcaataccgtggtgttttttgtacccttcaaggagtacatctatcattttgacacaggtcttctcgtccggttcaagaacggtcaacacttcaaaacgacggttgaaagcttgttcaggctcaataatttttctgtattcttcctgagttgtggctccaattacggtaatttcacctctggcaagctcaggtttcaggagattggcaacatttccgatgcttcctttcgggtctaagagggtatgaatttcatcaatgaaaagaatggctttttcaattttcttacattcattgatgacttttttcaggcggtcttcaatttcgcctttataagaggttccggctagcaacgctccggtatcaagttctaaaagggttccgtttttaagcatttcaggaacattccctttaataatttctgtagcaaagccttctaccaaagctgtttttcctactcccggctctccgataatgatcacatttggtttacttctgcgacaaagaatttccaccagcattctgagttctttgtccctgccgatgatattttctatttctccttttcttgcctgtgccgttctgtcgacacagtaacttttaatagaaggaaaggaagaatctgaatagtctgaaccatttgaaaataatgatgagaagttcccatcttctgaaacagtaaacggagtatcttttctgtaaagattaaagatttcatgttctctcaaaggaagtgattttaactgctgaagagagaatacaacctgtggttttacaatggctgtaaggatgcagataggagtaatctcatccagtcctaattttaaacggatatcgtcagcctcttcaataagggtatccactgcatcatcctgccctacttcatcgggaagatgactggttttcggatattcttcgatgcggacatctgcccattcatagaagtatcccggatctttatctatgcttttcaggaattcattaagtccgatatctttatgcattaaagcctgcaggatgtgcgggccaccataagttccattataattttccttcgctatcgactgagcaatgtgaaatagttgctttactgtttcgttggttactagtactcccatttataattttcttatattaatatatttgcgttctgttttatgtgctgatttgatggtttcgatccatattttccatcccttttatcagggtataaaaaattgttctttttatgatgctaaaattagttattttattctaaatgatataaagatagttaattcttcaaatagagaagaagcatgatttgttgttttaccctggtgacctctattggattataacctaaaagaggctattaatattgctgaattaatgaattcaccctatctacgtcataatcaaaaacaaattctttgttcatttctttttttgaatgatattgtctgtttttttcctcttctttatgtccatactcctgatattcgctttctatttttccaactcttacaaatttattttgcttccaatcctgaaaataaaattttgcaacaatattttcttttaccgtagaatttgtaaaatctgtatgttctgcattcgttatcgtatttttttctctaataatcaatatgggaactttatttttgagataaacaatcaggttgtcatgactccattcttctccggcggattctatttttatgatatcaggatctgatagttctttatttattttagatatcaatttttgctcagatttattttgggaaaaaactaaaacggataaaaaaattaaggacgtttttattactttttttatcataagtaatcttttcaaattcattactaacttttggaatcattgtttcttgtaattcctgagattggcattgtagaaaaagacccaacaagaattatggattataaaacggtactgtttttttctgaagctcttttcctgttttaccatccagaatgatttcttctattttgtcgcctgcaatttgatgagaaattctccatacttttttgccttcaaaatcctgttttaatactctggactggtaaccagaatcatggtagcctttaggcagatcaattttattcttttcgcagtatgcaataatatctgcgggtttaaagtcgtagccttcatccatgttttcctctttaaggagcttaccagattcgtcaaaatgataccaaataccaactactgagccttcattgaacaaacatccttttttctcaatattaccattaccatagaaaaatttagtgaccttataaaacaaattatcattataaattatttctctataacctggtgattgaaaatcctgaatgtaggtatttttattttcccgcactttcaagtatcctcttactgatttcttttggaaattttcaatatcaaatttttcatacttattatcaacaattggtatcatatatttgtctattttttgagattggcattgtataaacatactcaaccacattaacactattattttattcataacaacctattttatagatgaattagcttttttccattgccaataatataatgaacatcgcttattatcatttcctccatgatgcgaataatctaataaattatctgtctttctatattcatacgtatacaatgcatgagaagatgcctccttatttgcaaatgtatgggctaaattcattgaatgaagaaattcatgtgctgctgtctgctcgtttttacttttaaatacgaccacataatctgctccataatttgaatatccggaaacgtgtcctcttgcatcataaccatgctcagcaaaataaaatgctttgaaatgctttgtatatttcttaggataagccttttccaattgaactttcaaataatcctgtagctcttttccaccactcattttaccaggatctacctcaccactggttacgaagtcaataaaatttttatctgccgttaaatctaattcaacaatatctgaatcatccgataatttgatatatgcttgctcaagatattgatttatcctatttttttcatcattaatattaggtttattcttccctgatcctattgacaattccggagtttttatttcaacaaatacaacatctttttttttctgttttgtattatcattggcccagacatttattttcccggcaattgattcaacagttgctcctgcttcagttttaaaagcttttaactctatagtctggttacttgttaactcttttatgcatttgattgtaacttcataatcgttcaaagctattttctttttaccttttatttctattttatcaggagtaaaagtaaaataatcagatttggtaaactccaaataatcagcttcttgttggatttctgcaaaaaaagtaatcttaatttctttatcttttaggatagaaagccacggtatgaagtattcttcaggaacatcttttcctgttttatcttttttcgttttccatgcaacactgaaaggattatactctttttttaagttattaaacatcgtttcgctaacctcaaagtatccatcatatttattgccgttttttacttttgttgtaaacttggcatcttcatactgatatgctacaatatcctcaaatttttgatcattaaaaaggctcgtatctcctattctcatccaatcaaaaccaaactctcctttccagtttttattcggtctgaattgcacaatcaattgtatcagctgttgtagtggtggagattggggagtattatgactcacacctttagcattccctttttcagaaatccatttcatggcacgtgaaataatactctcctgagaatacatattatgattttcatgtgagattttattgtaggtgccttttacaattctcgttctgctcatggttaatgtgctttagatttctcaccgctgttattttgaacttcctgctgggcatgtttattaatggaagcattggaagtaatgttgatttccttctccgaaatctcatttctttccttctttgtttcactatgcacatctccttcaatgatctcagtaagtttacccgtaataaatgtactcacatttcctatgaccgaggtaagtttcatagcgcctacagtctcagtattatttaatccgatactatcagacttattcattcccaccgtcgtagtcatattctcccctacattaatgttcatatttttgcagttcagggtcatggtttccggtgctgtgatattgatattacttcctgtagtatccagatggatctcattgccgctcttatccgtaataataatgctttcatcttctgtaaaaacgattctgtggccgcttcttgtctggatagattttacacggttttctgctccaccgccaaggcctattcctccatggaacatccctcccattacgaagggtctgtccggatggcaatggacaaaattcaccattacctgatctcccacttcaggaattgccacatacccacggttctgagtaatctgatcggttcctcctgcatccggactcattacccggacaaagtgagtggtatcattcatctgccagtcaaatcttacctgaactctgccctggccttccggatcagcatttgagattactgttgctatctgcggttgggcagcaggtattgtaaattccggtttgggtaaaaagcctgtatcagccgctatggattcaaaagttcctgtgtaatgcccaattgtatcaatttcatgaacagcttcagtgatcatgacctttgtaaagtaggaagtttcattgctatccggctttctcatatgaatatctgcaatgcatcccggatgcaaaaacggaactgttgtagatccagaaacagaaaacacattaacggcttcacttcctgatgtacttctctgggagtgctctacatccagatgtgtagttgctttgatgggcgcaatctgtaatgccggagttttatatattttatcattatggctgtatgccgtacgggccagatcacccaaatgactgaccggtgtttcacctgaagtcagtttttcgtttttactgctgttatatccgtaatattgaggttttgtatgaacagcttttaactctactctgatattatccgcattgcttccatacatcagctttataggtttattctgaggtggaagttttccaaaatgcaatacctcaccatcgtagtagaattgttctccataagcttctgccattctcgccagataattataatgggtctcgttatattggctgctgtaaataatctgagaataatcgttggtatccactcttatatcaaaccgttctttatccagcccctgtttgattactttttctgcaatgattcccatattaacaggttgtccaccgccaaaactctgaatatgtggagctccatccagcaagatggtcggactgtaccctgaaagcacaatattgccaagactcattttttcctggctgaatcctactttggtaataactccaacaaaatttctttcggggctattctcaatatctttgtacgacataacggccgtgagacgttttccaagaaatttattagcttcttcaagtgtatggctttgcctgtctcccagtgcatcatgagcaaggataagattgaattcgtggtggtgacccgctttttgtttaagagtgaaatgtttatagtacttaataattttgccttctacaaccagtgacaatttaaccagccggttgatgcccgtatgatgattctcggatattccgtcggcattttgtgacggacggaaagaagatccctttgtctttgattcggttttcatatgctttgtgtttgtgttggtattaaagatagtaatattttacgtaacagacattatataagcctgttgtagaataaaatcctttgtgtaagtttttttattcaggcaaaaaaagaccgcctttaatagggacagtctttttcttatgaatgttgataatgtgtgtaatattagcttgacggccatagaccagcatattgcgaagtaccatagtcaatggtttcagcacttactacgaagctgatcagcatactattgctgtcaatggcatcgaagtctacctgatgttgaattacatatccgttttcccatttcagagtgatcagtgttccttcttcgtgagatttattgaatgtgatttctcctactgtcggcttgtatttaccatttaataagctttcaaggatgtctgatttttcagtagcttctaccgtaaccttgatgagagcgttggaagggtctgatgctacacgtcctgatacgtctgtagatcttgatacactgtaattcatttttaacagtttctgtccttctccattattgaattttaagattcctcttgaatttctttcggccatgattagtaaattttaatcgttagtaatattttgtgattcagtgattgtatagcaaagatagaggctcttttccgctaaaaaaaacttttcagtataaatctgagaaattgtagtagttctacgatttgttgtcgtaattctacgacaatagatttaaaccctactctataactcccaccaatgaagcattttaagttaaatcccgtattcaagaaaaatatttattttacacatacaagagaaataattagggtgaaagtttaaatttaaggtacaaaatttaaggttgttataaattaaaacagagagggttcattttacaacacaaaaaaagcagaagttaatactcctgcttttaatatcattaacttaaaattcttaatgttttgtgtattccggctgttccgtaggcattcttgacggagtaaagtattcattaagccagtagaaagtctgtccgttctgctggatttttaccgctgggttatttctgttcgcaagcattctgtccgccagatttttatagtggtaaaaatagtttttcactgtttcattaggaacaacttttgatttcttccagcctttcagtttatacttagccatcaattcttcttcagaaagatcaaatcctgtgctcattccgatagcataagacattggcagctcgtaaagcgctcctttatccaggaattttatcgtaggattatatttcttaagcagcttaacgtattctttaatagctcttgcctgattaaagtctgcacggtcagcctgggtatttctgtatacttccgtgtagaaagctttcagattatcatattccgattcagaaataaggattcctttttctattgccggtgtaaattctttcagatcttttggaatatatcctttcacaaggaacgggcttccgtaattgatcagctgtgctgcaatacctgcagaaaccggattggtaagtcccggatacagatatttatattttaaatccacatctgttcttcctgctcctactgatgaatggaaatattcattaagggatttatcaaccgtctggttgtctaaagtaacctgtgcaataaggctgtcaactgatttcttcaggaatcccggagtcgtaatgtctccttttttagggaaaataacgaatccctgggacatactctgtttagggtaagctaaagaaaagaatcctgcatcaccttccacaaggctgaaattattcttggtcaaaacatcattttggtcgatgatcttttgttttttgagttcagcaatattcttagccgtattggtaaccacattttccgccatcaatacgaaatcattataggtatcggaagatcgtgcgctggtctggaacatgatcagtcttgcctgagcctgagtcagtgaactgattacgctgtacatattcccgctctggttagcagtagttcctacagttacaacaatattggtttcatcaggaacatttgaaagaaggttcccggctgcagtaagagcttctcccaccggctgataaccgttattgcttgcgcagttcatttcattcgttttctgatcaataaatgaagtgattttactgtaatctgtacttaaggtggataccgcaacattatctccacatggattattcttatataaaactgctccatatttaacattgttaaaatatgatggtttttcaaatctgagctgaagatcctgcagcaatgattttacaataggggcataaggcgcattggaagcacttacatccaatgcaaacacaatattgatatttttatctttttccgtgatctctctgtaacggtcaaaatagataggctctcccaatacgttggatacaaagtttttgctgtaatctaaaatattggtgaaatattttgtcttgatatcaggagttggcgtttcttctaacggaagatttatcggataaatgttttccagaggggttctcttatttacatcggtaagaagaatagccgttttattagtagcatctgatgctgatcctccaggatgcccttcatggattcccaatgttgtatcgttaatccctgttgtattcttaagtttgatggcagaacgttctccccatgtagaaatcacatttgagcttacccatccgtaaagccctttactgatactgtccatgtcaacagaaggttttttacctaccaggaaacgtttgttattctcagccatcttgtatacatatacaatctgtccgttagggattttcacattggctgtttcaataagactcggtgagttaaacaccataatagagtcatttttatagtacctttcagcatttctgatgacctcactgttattgggaactacagctactcttacaggataacctgttttttcactttttaaagcgttattccagagaagaagatccgattcaggaatccaaccgtatgtcttaactgattttgacgaaacttttttcattaaagcatccggaacatattccgctacttttaccattccgtctctatgtttcagaaccattaaaggctcaaggaattttacttctttgtaagacttctcatcatctttatccagataagctgtatttcttgatctgtctgaaatgacgatccatggaactgacttttttggatacccgttaacgacaggggaagcatccacctgcccatactgtgaaggctccggggttttctttgacggcagttttacctggcaactcgtcaataatactgataaccctatataatatgctgctagaggaaatttatttttcatcctatttaatctttttatgattggtacatccgtaataccggacgaaattatttgctttgattgatatctactttcgttacacagttctgcgtgtcatccaggtttacttttacagtctggatcaccgtatttttgtcaaactgaagacctgcacaatacatgtagaagttgtttactttactgtcatttacttttaccactgtattttcattgttacacagataagtttttaacaggtaattgtaatgcatattgaaactgtttccgtttgcaatctgctgcaggtgatatttgaaatcgttgtcaacttttgcataagaatcttctacagaaatttcatcttctgcaagagcatcataggcaggaagaattttaatacggtggtaaacaggatcttcgctttcttctgtataaagcgttacaagataatcaccgggctttttataggaataaattgtaaatttatctttagcatctgtgttgccggtttctccgaatttccatgcaaaacgctttgcttcagaaacagcacggaaaggtacgttttcattttgcattgcctgtgcaggagcttcgattgtcgtggtaatcttcgcagtatcctttggcttctgaacgcttcttgcgcttaccattacagggaaagatttcgtgtacttattgtctacgatcaaactcacctgataatatcctggtttattatagaagtgaataccactgtttttatctgaagttgtcccatctccgaaattccatcttttggttttggcaaactgggttttatcttcgaataaaagcgtgtctcctaccgccagtgaagacggataaaccaccccaacaatatcatctgccgaatgtattacctttttctgcagccacagagcaaccaatgctgcgatcagcaaagttgcaataacaccgataataatgtttttcttgttcttttgaaaataattcatagttagtaattgtgatgtgttttatttatgttcctagtatttttttgcttactgcattcttgctttcagatcctgctcgcgctgatagagcttattttgcttatctttaaatccgattcggcattcatctacctgcttctggaaaattttaatgtcttcagaggctgttgaaagaactttcttgtcttcaaaatacattttatagaattttgcaatctgaggataggcatccttacggatatccacaacgtctgtactgttgaaatagctgttaaggtcattaacgcccagctgaatattgttttccatgaaaggttgtggaccgtcatcggtaagtttgctgatcatggtataagtactgtccatgataggaagaacaattttctgatgtttttcaaacgcagctttctgttcaagattctgaattcctcttacatcttcatcagaaaagggagattgaaatccttttaaaaagattactcccaaaaacaacatggcggtcaccagcatcagtattaaataaaaaaactgataatgcctttctttcttagataatgtgatttgtccctgcatatcttttctttttatcttcttcttttacttcctgtgaaatttcttgtaggatcttttctaagctcgttgttggtcactcttatcttacccatacattcatccagatcccttatgatacttttcttctgatactctacctcaatgatcttagcttttaagttcatcataggtacaatctgtttcatcagtacggcataatgcttaaagctctccacactgtctttacccataatgtttttggcgtctctcacattatccataatattggttctgagaaacacttcattctccaccttattaatactaagctggttcattttgtcgtaaatatcatcaatgtgatctttcagtacgtcacttcgaagcatcagttctttgtaggcttcagcttcacggctgatcccttcccgctgtatatcataactcttaaagaagagaaataagcaagcaaaagatacaaccgacaaaacaacaaatgacagaataaacttccaaatgcccattctgacgtcagatttgttcaattttttttccctgttagaagacataatttgcgatttgtttggcctgtgaaaatataaaaaaaaaaattcatgcacaatacgtaatttccccagccttgtttcgtgaaaaccctgattaaattaatattaattttcactttgataagtttttcataaattagacctctgaattttaaatatcattcgccaaatcgatattaagaatgagcaaaatattatctaataccgtacgtttttccattgctgacagtgatttttattttaagaaaataatgatcaaaacacttatggaaaaccccttctatatgcttctgaatgattgtaataacgggcatgaactggtaaacagaatctacagaagacaggaagacgtgttcattattgaactctttatgccggtattaagcgggattgaagcaatcaaatacatcagaaaaaacaataccgaaactcctattattacctattccggaacctatcaggaggatatggctgaaattctttcaaagattccaaatatctactactgtcagaaaaagagcaccatcataaaggacattattaaaggaagtattgtttctgatgacttcgactaccaggcctattccaaagaatgggaacagcagcctcttgctgtacaggaatatatggacaggcagaaaaaagggcaggaagagctttcaccctctgaaatacagctcatgagattctgttatgaaggattcagtaataaagagattgcagaaaagcttaatctgagcaccagaactattgacacttacatcaaccgtcttacagaaaagctggggttaaaaaccaagcttcaccttataagattttgcgtagaaaacggatattataattccagcctgtaaaattctgattcaagcaatatttttttaattccggtaacaaataaggataatcagagattctttcaatgtcttttgtaagactacaaaaaccctgcagagccttccaaaaccgttatttattaatttttgttcatgttttttccgcatcctaattcagccacattattttattgttaattattacaaccctgccttaatatggcgtatatataaaaagtcctgctctttgaataaaaatattttgtcactaatttgctagtattcaatttttttaactaaatttgcacacctaaaatttaaaattaaaataaggaaatgacaaaggcagaattggtaaacaccatctcaaataagttgggaacagaaaagaatgaaacacagaaagttgtagaagcttttatgcaggagatcagaacttctatgtataatggggataacgtttatctaagaggttttggatcttttatcattaaaacaagagctgctaaaacaggaagaaatatttctaaaaacactgcaattgagattcctgctcataacattcctgctttcaaaccttcaaaatcttttgttgagaaagtaaaaactaaagttgcagtaaaataagaacattaactgaatattaactagttactaaaaaattaaaattatgccaagcggaaagaaaagaaaaagacacaaggttgcaactcacaaaagaaagaaaagaagaagagcaaacagacataagaaaaaataatctctttttcccgagatttacaatataataatatagttggtggatttaattttttaaagttcactaactatatttttgtttgcaactataagattccgcggaaaacggagggtttcaaatattattttaacaaacatataatggttttcattcaaaatccttatatttaatagatgaattaatcaaaaaaacatccacttcctataatcttaacaattttatcttattaaaaaatgaagaaagaactaatagtttcgcatgaagatgatcttacaaagattgcgctgctggaagacggaagactatgtgaacttcatgagcaagaagacaaaagcgattttatagttggagatctgtttataggaaaagtaaaaaaactggcacccaatctgaatgcggcattcgtcaatatcggatatgacaaggatgcatttctgcattatcaggatcttggaccgcagtaccttacgtaccgaaagtttttaaaagacactatttctaaaaaacaaagcacttcgagcttaaaaaatttcgagatacaacccgaaatagacaaaaacggaactgtagacaaggtaatcgccaaagacgatctggttttgctacagattaccaaagaaccaatttctaccaaaggtcccaggatttctacccagatttcattaacaggacgctttctggttttaattccttttgacaataaagtttctatttccaaaaaaatcagaagctctgaggaaaaagaaagactgagaacccttatcgacagtattaagcctgaaggattcggggtgatcatcagaacggtagcagaaggaaaaaaagtagccgaccttcataatgatatgaaccagctggttcagaaatgggaaagcacttttaaaaatatccagagaaataaagttccgtctaaagttttaagcgaagaagacaaagcttcagctattttaagagacaattttaaccaggacttcgtgaatatcatctgtgatgatgaacagatggtgaacgaaatgaagaattacattgaagtaattgctcctgaaaagaaaaatattgtccagttttatgattctcatattccacttctggaatattacaatgttgaaaaacagcttaaacagagcttcggaaaacacgtaaacattccaagttctaaaggagcctatcttgttattgagcacacagaagcacttcacgtcgttgacgttaactccggaaacaatattactaccggaacagcggtcaataaggaacacgcactgaaagtgaacaaaatggccgctactgaaatcgcaagacaacttcgcctccgcgacatgggaggaatcatcgttatcgatttcatagacatgccgaattctgatcacagaagagatctttacgaacatctcaaagaggaaatgaagcgcgacaaagcacgccacaaaatacttcctccaagtaaatttggtctgatccagatcaccagacaaagaaaccgtccggaaaagcagatcgaaaccaaagaagaaaacccgaacaaagacggagaaattgtagctcctattgttatcgtggaaagaatgggtgaaaccttaagaaacattctgcagaaagaaaaaggaaaaatctacctgcatgtacacccattcgtggaagcctaccttacaaaaggcattaaaagtatccagatgaaatggtttatgaaatacaaaaaatgggtaaccattgttccaagagattcttttaaatatttagaatacaaaatctataatgctaaaaaagaagaattaatagaattctctaattaaaaaatttaagaccttcagttgtactggaggtttttttattatctttcttgctataagtttcggctgaagccaatggacgtttttgtttatccaggctgggctaaagcccacccctattgaattttaacaaaaagacattttactttttactttttacttttatcttttatcttttatctatgaaaaaccaccattataaaaccaccatccaatggacaggaaacaaaggtaccggaaccagcggttacagagactatgagagaagccacactatttcagcagaaaataaggttgtgattgaaggatcatctgatccggcattccgtggagaccgaacaaaatataatcctgaagaaatgcttttatcttctctctcttcctgtcatatgctctggtatctgcacttctgttccgaggctggtattattgtgacagaatatacagatgaagcttcaggtataatggcagaaacagcaaatggaagcggtcattttacagaagtgatcttacatccaagagtgaccgttgcagaagcatccatgattgaaaaagcagaacagcttcatcataaagcgaatgaatattgcttcattgccaattcggttaattttcctgtaaaacatttccctgctatattagtgaaatcagaaaaataaattcagatcataaaatatcaattcactattcacttgcgaagcaaaattcaccattaacaaacttttcctattggttaattaatgttaaggcccttatttcttcaagatatattgctaaatttgagttatggaaaattttggaaaagatttattgagaaaaataaaaagtgtggaacttcccggtgagcacgcacatggagtcttctcacctccctaccgtcctgtttttacttatgatgaagtattggcaaagaatcccaaatttgcagcagtcaatattgttctgtatctgaaagacaacgagtggtattttccattgattcaaaggactattaacgagcacgacagacatagtggacagatatcactgcccggaggaaagcgtgaggaaatggacagagactttgcagaaactgcggttcgtgaaacctctgaagaaatagggatagacaagcattatgtaagaatcatcagagaaatgtctcctatttatattccgccaagcaatttttacgtatatccttatatttcctatactaaaaaaaatcctgcttttgttcttcagcagacggaagcagtggagacaatcgaatttccgatcacatcctttctcaatctttcagacacccctgaaattatggccctgccaagtgcaggcggacatgaagtccctgtcattaatttcaacggatacattatctggggcgctacagcaatgatattaagtgaattcagccagttgctgaaaaatatgtaactttgcactaccgtgtttaattgagaaatggcgaagaaaaatattttcaccgatgcattcggaacaccttattttttgaaaaggtttattatttttattttaggtattgtatcctacagaaggttcaatggctttaataaactgaagattaccggcacagaacaccttgtggatcttccggattccaatgtattgtttgtgtctaaccatcagacctattttgcagacgtagcagcgatgtaccacgctttctgtgctgtaaacaacggatatttaaacacaataaaaaacccgatctatctgttaaacccaaagatcgatttttactatgttgctgccgaagagaccatgaataaaggtattcttcccaagattttcaaaattgcaggagctgtaacagtaaaaagaacctggagatccgaaggaaaaaatgtcaaccgaatggtagacatgagtgaggtagacaatattatgaaagcattggacaatggctgggtagctactttccctcagggtactacatcagcttttgcacagggacgaagaggaacggccaaattggtaaaaaatcagcgtcctattgtgattccaatcaaaataaacggattcagaagagcttttgataaaaaaggactccgcgtaaaggtaaccggtgtgaaacctacgatggaattcaaagctcctttggatatcgattatgataatgaaaaagcaccggaaatcctgttgaaaatcatgactgccattgagcagactgaagatttcaatcttttacacaattatgatgaagaacttaaagctaaaaaattagaacaaaaggattcaaataattaagtaaattaaaaattatgaacaaaatacttggaatattattcgcaatcatagtattagtttcatgcaacagccagaaggtatattcggattttgatatcagctattcgaaaagcggaggctatgctcctgtttatgaaaacctccttataaaagggaataatgcacactactcctttgaaggccagggaaaaaaatacaaacaggattttaaaatttctgatgaagatttaaagaaactggaccaggttctttctcagaataatttcaggaggatacaggaagaccgtaaaaaattgtatgacaatatttcgacttccatcaatgttaagagaggtcccaatgaaggcagtaaaacggatgcgagtatgatcattccgaattaccagaccaactggaacaatattcttgaggctttccagcagatcattaatattaatgttaaaaaacagtaaagacaattgaaaacccactttattgccattggcggaagcgccatgcataatcttgccatcgcattaaaagacaaaggatatcaggtaaccggttccgatgatgctatttttgaaccttcaaaatcccgactggaaaagaaaggaataatgccccaggaaatgggctggttcccggagaagatcactgcggatattgatgctgtgattctcgggatgcatgcacatcaggataaccctgagctagcaagagctaaagaactgggtctgaaaatatattcttatccggaattcctttacgaacagtctaaaaataaaaccagagttgttatcgcaggatcacatggtaaaacaaccattacctcaatgattcttcatgtgctgaattttcaccggaaagatgtggattttatggtgggtgcccagcttgaaggttttgactgtatggtaaaactgacacaggataatgacttcatggtgctggaaggtgacgaatatctttcctctcctattgacctgcgctcgaaatttttactgtatcagccgaatattgctttaatgagcggtattgcatgggatcacatcaatgtattcaaaacttttgatgattatattgagcagttcagaaagtttgtagcaagcattactgcaggcggagttctggtatacaatgaagaagacccggaagtagtgaaagtagtggaaaatgctgaaaattatttcagaaagatcccatacaaaactcctgaatatgaaatcagcaacggtaaagtatatctaaaaacagaaatgggagatgttcccctttctgtttttggagcgcacaatctgttaaaccttgaaggagcaagacatatctgtcagcaactcggcatcatggatgaagatttctatgaggcaattatgagcttcaaaggcgcctccaagcgtcttgaaaaagtggaaagagaagataaaggaatcctttacaaagattttgcccatgcaccaagtaaggtaaaagctgccgtaaaagcattcgtagaacagtttaaaactgataagaaatatggatttctggagcttcacacctattcaagcctaaatcctgctttccttgagcaatatgaccacgctatggatggtctggacgagtctgtggttttctattctgaagatgctttgaagattaaaagaatggagcctatttctcctgaattcatcaaggaaaaattcagaaatgatcatttaaaagttttcactaatgctgaagatcttcatgcctactggaatacattagataaaacggatggtgtttatttaatgatgagttccggaaactttggcggattagatttaacaaaataactcaataaaaaagcttcagaaatatgatctgaagcttttttattgatgtttgtttatcttttttcacactggctgattaaatgtttcagaatctcttctgtagaacgttcactatactgatgaatggattgtccgacccagattcctacaaactccggattttgcagtgattttgctgctttgcgcaacgcattggtgagtttgttctgataaggatacggtaaaatatattccgagttttcaacggtttctataaatttattttttactcccctggcatatctcccggagaagctcttcgttagaacaatttcttcttctcttacttttttcaatctttctttttcaaatggcagtaaggcactttcctgagaagctagtagaaggttaccaacctgaaagccctgtgctcctaaatctttaacagcctgcaatgttcttgagccatagattcctcctgcatagatcaaaggaacatttacctgatcatatatctgcgacaataaagatagacctccgatctgcggaatatcttctgcttcgaaacttcctctgtgaccgccggcttctattccctgaacacaaatgatatcaataccggatttttcaagcattaaagcttcatttacagaagtacatgtcccgataagggttactccgttttcttttaatttctgaatactctgatcatcaagatttccaaatgtaaaactcagaatcttacatccttcctgaataatggcatccacctgttcatgataactgttaataccgatcgcagcaaggtccggaagctgtacttctatattattttctctggccagctgttctataaactgcctggttttactatatttttcttttaaggcatctgtcactgcaggaatgtaatggacaaaaatattggcagcaaaaggcttatctgtcagtttttttgtctctctgatcaactcaacagattgatctgcagaaagatcagccaatgccaatgatcccagacagtctgcctgagccgctgcagcagtcatttgtaccgtgctgactccaaacatcggagcctgaattacaggatattttattcccaacttgttactgattgtatccggccaaaacataagaattattttaattaaaaggtacaaaaaaataggaacagctcattttcaacaggatatgacattcctcatcctgaatgaaaatacaattcccacaggtttcacaaaaaacacagattgtaatctgtgaaatagtgaaagctgtgggaatattcttaatttccggtttttattatatatccgctacagaatttagcatcttttgttcccacgcaggatctttcggatcaaagaataatctttttcccgtatctaagctacgaacaacattcatttcatcttctgtaagttcaaaatcaaatacattaaagttttcctcaattcttgacggggtcacagattttggaatcactacaaacccttcctgcagatgccatctcagaatgacctgtgctacggttttaccatatttttcagcaattgctttcagatcaggattgcttaaaagattcgcattaccatttccaagcgggctccatggctgtgttataatattgttttccctgtcatatacctgcagttctttttgctggaatacaggatgcagttcaatctggttgattaccggtaaaactgttgaatttgctttcaattcttccagtttctcaactgtaaaattacatactcctatagctttgattttcccctcctgatagagttcttccaaagctttccacgttcccagaaaatctccataaggccaatggataagatacatatcaagataatccatctgtaatctgtctaatgttctctgaaaagctcttttcgctttttcatatccgtgatcctgaacccagacttttgatgtaataaacagttcatccctgtctactccgctattttttaccgcagcacctactgccgtttcattctggtaaatagcagcagtatcaatcattctgtatcctgtctgaatagctttgatgactgcattttcacattctttcagatcatccatctgccatactccaaagcctaaagccggaatatccactccattatttaaagttaccacaggctgtcctggataggttttcttttgcataagtctttattttaatgattaatataaagtgataaacaaatttgcaataaaaaattgaaaatccggcctaccatttttactgttttatgttaatagactgctcttgtattgctttttttaaactaccccgtctttttgctttgcaaaaatccaccccttcaaggaaggggaatgagtagtcgataaaaccaactctctacacttctaacttccttcttccatcttccagcctcaaattttctctcctgtcggcatttctcctcaattttctctatttttgttcaaattaaaaatcatgtcacaacatatcagactggctcatgcagaagattatccaagaattatggaaatatgggaatcagccgtaaaggcaacccacaattttcttgcagaagaagacttcaactattttaaagaggtaattccaagggattatcttcctaaccttgatgtttatttaattactgaagatcatgaagctaaaggttttgcatccgtggcagaaggcaacctggaaatgctttttattcataatgatacgcgtggaaaaggctacggaaaaaagctttatcagtttatgaaagagaaaaccggattgaccaaagtagatgttaatgagcagaatcctcaggcaattggtttttacgaaaaaatgggtttcaaaaaaatcggaagatcagaaaaagatagttccggaaaggattatccgcttattcatatgagtttataaatggaagattttatttttcatcaattaagttccgattcggaaataccttatcaactcttattattggccgatgaaaccaaagaagccattgatcagtatatttttaaatctgacatctatcttttacataatggcatagaagatattgctgtaatggcattatataaaatcaatgaggccgaactggaaataaaaaatgttgctgtaattgaaagctacagaagcaaaggaatcggaagtatcctgatgaacaaggccaaggaaattgccggagaaaatcattataaaacactgatcgttggaacgtcggataccggcttccaacagatcagattttatgagaaaaacggtttcaaaaaaaccggaatccggaaagatttctttattgaaaactacccgtcacccatttttgaaaacggtttacagatgcgggatatggttttacttacccattacctgtcggaataagcctttaatatgttctatttcggcctgatagttcgtttttttacggcatccgaaatacagtgtattttccagctttttctttccttcccagatcattttcacgtcaccgccttcaatgtcatttttacatagaaaatcaggaacgacagctaatcctgttcctcctttcagacatcggatgattgaattcagattgggaacgatataattgggccggaaattcggtttatgaccaaaatttaaggtccagaactggaaaaggtgttccatatctcccgtagttccgtaccatttttcgttcttcagccactcctctatctgttctgcatcttttgtttttaaaactttactgaaagcggcagtatctacatctttccctccaaccagaatgatctgctcggaagagaaggcttcatgctctatattgggggaagaaccttttttaggagtaatgattagatccagaattcctttatccagctgatccagcatttcaggatattctccaaaactgatgatcagattgaaaggcagtgatgaaacatattgttccagcgtagtctgaaaagtctcaaaacacattcccacactgattgtaggcgtaagcttttctgtagacttctgaaaatttttctctacatcttccagtttggtaagaggctcagcaacggcattgaacagcaccttccctctttctgtcggaatcatttttctaccggttctgtcaaacagtttatagcctacataagcttccaaagaacttaaatgcaggcttactcccggctgtgagatgaataaggcatctgctgcacctgtcaatgtcccggttttatatatcgctttaaaagtacgataccattctaagttaaccatgacttaattattaatattctgatgcaaatttacaaaataattataatattgatacattttcattttctagaaacgctgcataataatccggaattccgctttcccttatctggcgggcagtttcctcaatcggataagataactgtacaatttcaggggtaatcttttcttcatccaaagtgagcaccagataagaagccagtctgttttcttctttggaacgtcctacagatccacaattgacagcccaagagttattttcaaattgttttttaaatgataaatgagtgtgtcccatcacaataaggtcagcgtccgcattcttcagcatagatgtaaaaatctcatcattctcggactcatacagataggtatcgttactttcaaggcttgaatgaaccaattggatattccagtgttttttacctgttttatagtttaattttaaatgaaaaggaaggtcagcgagaaattttttattctgttttgtaatatgctttttagaatggtctattgcaatgaaccgggcttcagtttcttcttccgaatgctttgaaagaggaatgacgggaatatcaaaagcaattctttcatcatgatttcccatcagacagggaatgttcaggcttctgcttttttcaatcacttcatttccccaaggtgcaaaatctacaaggtctccaagacagaatttctggctgattcctctctcttcaatatccttcaacaccacttctagtgcaggaagatttccgtgcacatcgctaaaaacagctatctgtatcattgtccttcaatttgttaacaaatttacctgtcacaacataattccggtttagaaatgatatgatattttaccatgaaatgagaaaaagtaaattgccaatcgtcaatttttgctacgcaaagtcaatagtgaataattaactgctgattagaaatacctgtacatacaaacaaatcggctacactcaatccccaaccacacatcccgaacctataaaaaattcacaagcaaagcgaattgacttttcaccattcacatacaaaaccttaaattttgaacccaagaccttgaaccctataaattataattttaataatactttactataaattatattatttttattatacaatcgtccatcctaactttgcagagtaaaatttaaacaatcataaaagaaatgaaaaaagtactaatcatcaacggaggacagaatttcggacattccggaggaaaatataatcaaacgatcgcagaaaatacattggcagttcttaaagaatttgacaacgtagaagtaaagatcaccaatgtaagcgaaaattatgacaaacatgaagaagttcagaagtttgtatgggcagattacattatttaccacactccgatctggtggttccagcttccgaacggattgaaaaaatatatcgatgaagtgttcaccgcaggtcatgcaaaaggaatttatatgagtgacggcagaaaagctgagaatcctgaaatcaactatggaacaggaggaatgcttggtggcagaaaatatatgctgactacaagctggaatgctcctgcaaccgctttcacacttcccggagaattctttaatgaaaaaagtgtggacgaaggtccgttatttgggttccacagaatgaatgcttttgtttctatggaaaaaatggaaagcttccatttccacgatgtagagaaaaacgccaatatagagcgcgatatgaagctttacagagaacatgtaagaaatgtttttgaaaaagaattaaaatctgaactggtatcatgaaaaaaatactgatcacaggtattaccggctatattggcggtagtattgcaaaaaagctccttgagaggaattatgaagtgacaggactcgtccgtaatgaatcccatgtacaggaactggaatcattgggaatcaagacggttgtcgggaacattcacaatgaagaccttatcaaaacagctgttgccggcgttgatgcagtcattcacaatgctgattctgccgatgatgcttatgctgtggataactttatcaaagctctggagggaagtcataaaacatttatttttacttcaggttctgccatttttggaggtaaagaaaatggtagaaggagtgattttgtgtatacggaagattttcctttgactccaagactggaaatggcatcaagggtacttatcaataattatgtacttcaatctgttcaaaaagatataagaagtatcgttattgttcctaccatggtgtatggagaaggcctgggaataaaaaaagacagcatccagatccctgctctgattaatttctcacagaaaaaaggacatggtgtttattttggcgaaggtgaaaatatctggtccaatttacatattgaagatttggcagatctttatgtactggccttggaaaaagcaaaagaaggttccatttattatgcagaaaacggagcctcatctttaaaaaacattgcggaaatcatcagtaaaaaatatcatctggaacccgccagatctttaagcatacaggatgctgttgacaatttcgggcctgcaggcggctatttcggttttgcatccaacagcatatgcagcgcagataaagccagaacagaactggggtggaaacccgtctataactcaattgaaaattttatttaattatgaaaatttatcttacagcgattataaagtctaaagaagaacatcaggcagaagtatttgaagttcttcagaatatggtaaaagaaacaagaaaagaagaggcttgtgaactttacagccttcaccagggaattgaagacaaaaatgagtttgttttctacgaaatctggaaaagcgaagaaggattagcccaacataatcagcagttttacatcaaggctttcggagctttggttgaagaaaagcttcaggagaaaccacagatttatactacccatatcatttaatcatgaaaaaattagcgtttttaatgcttgcaatccttacaataggatttgtacatgcacaaactaaaaaatcaaagaatatgaaaaagaaaattttatttgtcgtaaccagccatgataaaaaaggcagtaccggcgaagatacaggatattatctgggcgaagtctctcacccatgggaagttctacacaaagcaggatatgaaattgactttgtaagtcctaaaggcggaactcctccggtagatggtttcgatttgaaagatccggtcaacaaagaattctgggagaacaaggaatataaaaacaaaattgaccattctatgacgccgtcacaggtcgatcctaaggaatattcaaccattttttatgccggagggcacggtgcgatgtgggattttgcagataatcaggaactggcagacattgcttccaaaatctatgaaaacggcggtattgtagccggagtatgtcatggtcccgcaggtttggtgaatatcaaactggataatggaaaatatcttgtagacggcaagaaaatcaacgcttttaccaatgaagaggagtctgaagtaaaattaacgaatgttgttcctttcttattggaagataagctgaaagaaagaggagcaaaatttgaaaaatcagggctttggcagaatcatgtggtaacggatcagagagtgatcacaggacagaatccacaatctgcaaagagtgttggagaagcaattttaaaggaattaaataacaaataatttttaaccacaaaagtcacaaaagtttcagacacttaaataaaaagaagtttctaatcagaatacagagaagagtatttaaagtctttttatatcgaaaagttcttaaaagtgtcaacattgaaacggcgagaattcccctccagtggaggggtggcgaaaattcaaagaatttttgacggggtggtttacacataacaattaaaacaaaatggaatacagaaaattaggaaacactgatttagaattatcaacaatcacacacggagcatttgcaatcggtggaaatatgtggggcggtaatgaaaaacaggattctatcaactctattcacgcatcattggatcatggcgttacttctatcgatactgcaccattttatggtttcggactaagtgaagaaatgatcggggaagccatcaaaggtaaagaccgttcaaaaatccagcttttgacaaaattcggattggtatgggacggaagcaataatggcaaaggagaatttttctttgatgctgaagacgaaggaaaaactctaccggtgtacaaattagcttctaaagaaaatatcatcaaagaagttgaagaaagtttaaaaagattagggacagattatatcgaccttttacagcttcactggccggacagcactacgccaatctgcgaaactatggaagctatggaactattgatccagcagggaaaaatccgtgctgcaggggttagcaattacagcgtggctcaaatggaagaagctaacagaacgttaaagcttgccagcaatcaggtttcttacagtatgctgaaccgtgctattgaaaatgatattgttccttattctttggaaaacaattcaggaattatcgtgtacagtccgatggaaagaggtcttttaaccggtaaatattttaaggaaacacaattgaaagataacgaccacagaaacggatatttctctcagtttgatttgaataaagtgaaaactttcttagaaaaaatagaacctattgcacaggaaaaaggagccagcctttctcagctggtactaagatggacaactttacaaccagccattaccgttgtattggcgggagcaagaaatgcacagcaggctattgaaaatgcaaaagcaatgtctattgacctttcacaggaagaactgaagtttatcaattcagctttgaacgagatatagcattataaagctggaaggaggctggaagaaagaagttattgatgtcggataaccaatagattggtttacgattgaacttcaactgtcattccgacgaaggaggaatctctttgttacatgcagaaaagtgcatagaaaccacctaattatcaatacactaatagaacttcctcttccagcttcccttcttaaacctcaatccttataaaaatgaaaaataatctgatcaaagtattcgggttagcaacactattgactataaacagtattgcattaaatgctcagaccctcgttaatcccgaagaccaatcatggtatccttctacttatggtgcacaggatgagatcggagctgccaatttattgacacctgaagttgtaaaacaggcattagggctcgtgaaacaaggtaaaacgctggcgcttgcggttccgattgataaaaatcttcctgctttcagacacagaagttttaatttatacaatattcaacccggagaacagggcggaaaaagcataggaccaaataaattcaccttcaatgatgaactggtcaacggatggaccggcgtgggaacccagcttaacggaatcgggcacatcggaattgataacacctactataacggaaataaagcaacagactttgtaaccgtagaaggtgtcaagaaactgggcgttgaaaaagtgccaccttttgtaacccgtggtgtagtgcttgatatgactgctcattatggaaaaccaattgtgccgggaggaacagaatttacagtagaagacattaaatccgttttaaagaaacaaggaattactctgagaaaaggtgatattgttcttttcaacaccggatggcttgaattgattggtaaaaacaacccgcaattcctggaaactgaaccgggaatcggaatggatgccgcaaaatggcttgccgatcagggaatcgtagcttttggcggtgatacctgggcttctgaagtatatcctaacccaaaaagtaaagaagaattccctatcaaccagtttatgctggccaaaaaaggaatttataacctggaactgatcgacagccgtccgttggtgaagcaaaaaatctgggaatttttgttcgtgctgggacagcctttatatgtaggctctactcaggtgaatgtaaatcctgtggcaatttattaaattatagcttcccaaatttagaagaacagagagacaacgtaattgcgttaaaaaataaaattaaccttaaaatttatttttagaattaatacccaaaccaggttacattgtcactttgcttcttatactaaaacggcctttcacatttgaaaggccgtttttataaagtaaatatcagtaaattatgcagtcttcattgacttacatcttccatctccccgctcccagacttcactattttgcaatcggaagatgagtacttactgcaattctgttccaggcattgatggttatgatcgccataatgatctgggcaatctggttatcatcaaagaaagattttgctttctgataagtttcttcagttaaccccttgtcactgatcagagtaatttcttctgtcatggccagcaatgcctgctcttcctcagtgaaaaactctttagcttctgtccatccgttcagaataaagatcctttggggattttctccatatttgatagcatcttttgtatgcatatccaggcagaaagcacatttattgatctgtgaagctctgattttaattaattctttctgaataggagttaaagaaatagtctgtaaatacccttccaatcccatcatcgctttgtaagctgccgaatctactgttgcaatattcaatcttgcgctcataatattattattttttggttaattgatctatacttaaagaataatgttgttgtaccgccagtaaaagtgcagcagcacttcccacccatacagagtaattcagcggggcttttggtcctgatgcaatggtcatggatactgcaaaaatcagcagcagaatactgcttccatacgctgcaattctggttttaaatccaagaattagcatcaaagggaaaagaatttccaaaaatgtagcagcatatgctgaaaatgtactcagagattccggaagaaaaaatgtcagctgtcttgtatattctttaaagctttccatatttccccatgaagaattttctttgctccacaaccctaaccggtctgcaacagcagaaagcatcgtcacggcaagagccagccttaaatagagttgcggaaattgattttttgtatctgtcattgcattagcttttaatcacatgacaaatttccggcttatgatccgtaaaaaacttaaactggtttaagaacgtagttttgctttaatttcacttaaatactccggtgtaaatccgagaaacgaagcaacaaggtattggggaatcctttgaataaaccatgggtacatcgtgctgaaatggatatacagttcttctcttgaaaattcagacaaataacggagttttctttctgaagcggcgtaagccctttgataaataatccggaaataacgctccattacaggatgttttgcaaacaataattcctgatttttaaaatcaatcaccaaaacagtagaatgctccaccgactgaatattaaaatccgtctgctgctgcctttcatacgaaaatgtatccgtaatccaccagttttcaatggcaaactgagtggtattctccactcctttttcattgataaagaatttcctcagacagccctttaccacaaaaaacatattccggcatatctctccctcaagcatcagattctgcttcttctttacctccgtcaccttgaaaaatgatacaatagaagtatactcctcatcggttacggtaatgaatttatttaaatgtgctttgaatggatccattgtaagaattaatactcaaacttaactttatttttttagttttacaatgagaaaaatattgaatcatggaaatcgttgctaaaattctgatcactgtcgttgcactggaacacctttatatcctttggatggaaatgtttgcctgggaaactaaaggaaaagaagtttttaaagcagctttgcctgcggagatgtttaaacctacgaaaggacttgctgccaatcagggactttacaatggttttctggctgcaggactgatatggtcatttttgattaaagatccgcaatggcagaccaatgtggcattattctttttaggatgtgtagctgtggccggaatctatggggccatttctgccactaaaaaaatatttttcgttcaggcattacccgccattcttgcgattattgccgttttactgaaataacttgacaagctatcgtagaaatttctttccaatcaacattctcttaactttcataataagagaaaaatcatcatgaaaatactatttcaaaaccatactgaaaatcaacaacttatccacacaaaaatccatttaatataaattttgtaaatttgccccgtcataaaaaactgatatacagttttttgatactggcaagcattttgatgaaatgtagccattcaagttgttcagtacacatatctgtaattatctcatcagtaatttaattgtagactctatgtaaaaagattaatttcttttgcataatacactctttttctagagtataatctattgaaatatttaaaataaacataagactatcaggtctttatgctgttatttttttgcttgaagcttttatcactaaaggccaggcaaattattttatcctatcgtaatcagcagaacaacgaaagctaaatgtatatactaaactggtgtacagtttttatatcaaattattaattgaaaaaattctgaatatggaaaaaaatgaaaacacccgaaaagtaaaacttaaggttgaagacctgaccatcatctttggtaaaaacaaagaaaaagcacaggaacttttagacaaaggtttttccaaaaaggaaattcttgaaaaaacaggctgcaccataggaatcaacaaagccagttttgaaatttatgaaggggaattctttgtcatcatgggactgtcaggaagtggaaaatctactttactgcgttgtcttaacagactgaatgagcctacttccggaaaagtatacatcaacaacgatgatattaccagtaaaaagaacaaggaacttttagaagtaaggagaacggaaatgagtatggtatttcagaaattcggattgctgcctcatcataccattttagacaatgcaggtttcgggctggaaatcagaggagaaagcaaagcttcccgggacaaaaaagcacagaaagcactggatattgtaggattaacaggttttgaaaaccaatatccttcgcaactttcaggaggaatgcagcagagagtaggattggcaagagctttggccaatgatcccgaagtattgttgatggacgaagctttctcagcacttgacccattgataaaatctgaaatgcaggatcagatgcttgaactgcagaataccttacagaaaaccatcgtcttcattacccatgatctggacgaagccattaaaatcggagaccgcatcgtcatcatgaaagatggtgtcatagaacagataggaacagcggaagaaattttaaccaacccagcaagcgactatgtaaaagcgttcgtagaaaaagtagaccgtaaaaccattattacagcaagatctttaatgtttgataaagctacggtagtccgtttcagaaaagatggtcctgagggtgctttacgaaaaatgagagccaccgggctggaaaacttacctgttgtagattttcagaataaattccttggatttgttacccttaacgatgtcgtacgcattgccagaaagaaagaaccaacggtagaatccattatcaacagtaatgttccttcggtgtaccctgaagtgactgttgaagaaatgttaccactgatctcagagaataaatcgtccattgccgtgattgatgaagacaataaatttttaggtcttgtgacccagttatctctggtcatagaagccacaaagtttaacgaagaagaaattattgaattaaaagaaatcgcaaacaaccaataagatgaataaaactatagatataggtcaatatgtagaaactgcaatcaattggctcacagaaaatggaaaacctgtattcgatgtcataaaacacttaggaaatgcctctatcatggggattgaatgggtattaacaaacacacctttttatgtaatcattctcttctttacccttctggcactgtggaaggccggaaaagctatcgctgtggtaactgcagccggactaagcttaatatttttaatgggattatggaaagaaaccatggaaacgctggcactgatctttgtttctaccattaccgcccttatcctttctatccctttgggaattctggctgctaaaagcaaaatagcagacaaaatcatccgtcctttactggatttgatgcagaccatgcccgcatttgtctacctgattccggctgtactttttttcagtatcggaaaagtacctggtgcttttgccaccatcatttttgcgatgccgcctgcagtaaggttaacggcattgggaattgaggctgttccaaaagatattgtagaagcagcaagagcttttggagctaccggccgtcagattttgtttaaagtagagcttcctttagcgatgaaaacgattttaacagggatcaatcaaacgatattattatccttatccatggtcgtgatcgcaggaatgattgctgcaggcggtttgggagaaaaagtactggaaggaattaataatctggatatcggtttaggatttgaaagtggattatccgttgtgattttagccattatcctcgaccgtattactcagggatttgtaaagaaaaagcaataagatgaaacaattaaaatatctgtttttacccgttttaatgttactatttacagcattaagttcgtgtgaaaatataaaaaactctaaatatatcaccatcggaatggtagatggctgggcagaagatgttgcaatgacacaccttgctaaagccattctggatgagcagggatatcacgttattattcaaaaagcctctacggatatgatcctggcttcgatgaataatgaagatacagaccttttcatgggaatatggcttccttacactcacgcaaaaaagctcgctaaatttcccggattaacttatcttggaaccaattacgacaacggccgtataggattggtggttccggattacgttcctgtgaactcaattgaagaacttaatcaacataaagatcaattcaatcacagaattataggaatcgaaaaaggagccggattaaccaccggaacagataaagcaattatagattataaactggattatcagcagatcaactcctctaccattgccatgatcaccgagttacagaatgccatacagcgaaaagaatggattgtggtaaccggatggcagcctcactggatgtttggtaagatgaagcttaagtttcttgatgatcccaaaaagatttatggtgaagccgaacagattaaaacctattccaggaaaagcttttcaaaagatcatccggagctggtcagattcttttcaaaacttcattttgatgatgagaacatgtctgatcttttaatgaaaatggaacagagtaaaaacaaagaagccacggccaaagaatggttgaaagatcacccggaactgatacagtcgtggttaaacaaaaattaataaacaatttggtattatttaaaatcctcaactctataagagcctgaggatttttttgatttattatgcagaagaactcattgattctttgattttctcacgatgaaggattccccaattgactaatgtttctgttaccggaaatacagattttccatattctgtgacagcataggttaccgtaataggttttgtatcctgaatcgttcttgtgatcaggagattggtttccagctcttttaattctttgctcagcatttttgcagaaatcccttcaatactgcgttccagctttttaaaatgaatcatctgatccggtctgttcgtcagataccgtaaaatcatcagtttccattttcctcccaaaacatccagactgtcacgcattgcaaacagttcttctgtacagcttgcttctctttcgataccgttttcaataatttttgccataatagtttcatgaaggtaactagttaccattggttaactagtagcaaatataaactattccctctttacatttgtgtatcaaattaacaataatgaaagcagttattttaaataagaacggaacactggaagacggatttactgaccagccgcaacctaaaagtaatgaagtattaatacggattaaagcaagtggtttcaatcccattgattaccagatgctggaaaatgaactggaaaggaaactcatcagttctccgatattaggaagagaattatccggaattgtagtagatataggttcagaagttacagaattcgatattggagacgaagtctattgtggaagcggttctatgggaagtaacggtacttatgcagattacataagcgttcccgaggccattgtttcttttaaaccaaacaatatttcgtttgagcaggcggccaccattccttcagcagggcttacttctttacagatctttaaccgtttgaaattaaatccggaaaatacaatccttgttacaggtgctgccggaggtgttggttcattcctgattaaacttttattagcttataatatcaggaagatcacgacaaccgctggcagtgaagaaaacaggcagatgcttcttaatttaggattaaaaagtcatcaaatcatcaattataaagaagaaaatcttattggaaatatcctgaaagccaataatgacgagccatttgaatatggaattgatctcgtaggaaattacatgtcagaagtaacggcagaagttttaaaaatcaacggtatgtatgtagatgttactgctttggtaacaaaagatgctcatgagacattgttcaacaaaggaactttaatcatgaatatctccaattacgcgtatggtatgactaaaaaatacgactattataaaaacagtttactggaaataaaaagacttattgaaaatggaaccattcttcctccccagcataaaatagttggagatctttctttggaaactgttatgaaagcacattctatgttaaaaaataaccagacccaaggtcataaacttatcatgaaaaatgatgaataaaataccaagacgtatcgtaacaggaataaaagacggaaaatctgttattgtagaagatcagcaggttgaaaacgctgtggaacattttccgggacttatcatttcagatgtatggaatactcagacaatgccagccagcttagagtttgaaaccagaattcccaatacaggatttccgaaaacacctaaaaacggcacttattttaggtatgtagtagttcctccggataaagatttaggcgtagaatggaaaaaaaacgaatctcatccgatgatgcaccagactcctacgttggattatatcattatcctttccggtgaactgtatctgatcatggaagaaggtgaaacgcttttgaaaccgggcgacattatcatccaaagaggaacgaatcatgcatggagcaaccgttctgacgagccttgcattcagctggcgattttgattgatgcaaaaatttaatagtaaagaatttccacagatcacacaaataccacagataaaaattcatgtagatgcagcaaattttacagagatctgcataatctgtgggaaataaaaaagatttttaaagttgggaaaacgcaaaggcgcaaagaaaaataaacaataggttgttttaaggcgcaagaaaatcaaagattttcagcaaagattaatccatatagtattaggaacatacaattttatcacagataaaatccttgcgccttacagcataataaaaaaaaaattgcgcctttgcgttttccaacaaaaacctcttaacttacaaaccagaaaactccttcagtttctgcttcattttttcaggcgtcatctgcccttcctgataatacaccagattctgatgctgatcaagaaatatccacaaaggataaacaggctgatttttattctttgataatgccagtgccaattcatgaattccggaatttccattctgcagatattcaaatgtctgattttgaaaatgaatgatctccttcgttttctctgtctcaaagttgataaaataaaaatgatcattgatcatactcaccagctctttatctttattcaaacgataagcctcaatcttacagactgcacaccaatctgtatacagatgaatcaccaccggctttggattttctttctgctgagtctcaaggtcagaaaaagtgcccgtcttcatctgagacagataaaaacagggcactaacattaaaaataaagctaattttttcatttcaaagtatattttactccgaggaaacctctgattccctgcatgggtgcatagccatatgccgtatcaaaagtataatgattaggattattgatgggatcatcaacatgtttatcaaatgggtcaaatggtctcatcaaaggatctttaggtctgaaattgaacaggtttttcattccgcaatacacctcaaatcctgatttaaagctcttagacacctgaatattggccagagaataaaacggtgaatattcagggcggtagtcattcaccagaacaggaagcctcatcggtccgtaaaactgtcccgtaaagtctaccgtcagattattcgcaaacttataagtcaggttataagtaccactccattttggggcatgcagctgttgtgttttttgattttcattatcaaatttctgatacacatccagatatgtgactccaagattaatacttaggggaaattgaaagctaaaatctacattcaaagaagctcctctggaaattccatatccgtgaagattatcataaataattttattcggatcagaatcaaaatcccctacaattttattactgaaatacgtataaaatgccgaagcatcaagatttaccatcctgctacctaccggaattttccagatataattcaggttaccgttaacagatctttccggcttcaggtctgattttaccaccacttcccttgaaccggttaatgcagcgtgatcttccgtaaataaattcaccactctgaaacctgttccaaaattgaaacgtaaagtatgatacggattaggattgaatttccatgcaaacctcggcgaatgtacagaatggtgaactttatcataatcatatctgtatccaagcagcaaagtatttttatcattgatctcccactgatcctggataaaggcaccccagatcggggatttcatcggtgcattggtgatcccgtctgcagctaatgttcccggagtattatcatcataaaatgttcttttaaatgtaagtccggctgtaatatcatgcttcccgaagcttctgtcccaatacgtctgtacaaaagctactttctgtgtagcattgaatggattggatccataaaatgaattctggtcgtgataattataagaaaactgagtcacaatatgctctttcatgggccattcgtataatccgaaaatctctgccctgttggtataaatactttctccgtatacttcatcactgccacggaaagatttattccactgcatttcacctccaaaacggtcttcatacagatacctcatggcaaaacttgcctgtctgttttcctttcttttaaaattccatttgttaaaaaccgaaatcctgctttgcagcgtagcatccgtaaaattatctttattctgatctattctttcctgaaaactgaaataatttaaacttaataatgaagcggccttttttccaacattgaactttgtggaaagatccaggttattttcactccagctactggtcatcatatcaacactcagtttaggagcggtcagtgcatttttggtgataatattgatcactcctcccatggcttcagaaccataaatagaagatgccggaccttttactacttctattctatctaccaagctattagggattccgcttaatccgtatacggtggaaagtgaactcacaatcggcattccgtcaatcaggatcatcgtgtatggcccttccagtccgttgatgtgaatatctcctgtattacatacagaacagttcagctgaggttttactccattcaccatggcaatggcctcaaaaatacttggggtaggatttttctgaaaaaatttctgactgtagatctctaccgccacaggacttttggatctgctcattggttttatggttcctgtaaccactacatcctcaatgttacttgttttgtattccctcttcataacgctggcagaatcctgacttgtaatctgctgtaaactcaaactgtccgtctcctgtgcaaaacaataggttgataaaaaagtaatagaaaataatattcgcttcatgaaattaaaattgttagacaaatctaacaattatttttcaaatacaaaactttgcataaaaatatagattgagtcaattcatgaaaaatgattaaatttgagaaactacatacgaaagtaaaatgagatatcatcaatcgggaaatatcccaccaaaaaggcatacgatctttaagtctcctgaagataaattttactatgaacagcttttcggtacagaaggcttccatggtatttcttctctgttatatcatatccaccgccctacacagatcaaatctatcggtgagccgaaagacgtcactcctaagatcgctgtggaaaaaaacattactcccagaatgtttaagggaatgaatgtcactcctgaaaacgattttctggacagccgaaaaatccttttgatgaacaacgacctgaaaatgggattggcaaaaccaagaaattcgatggattatttctacaaaaatgcggaatgtgatgagcttttgtacgttcataacggagccggaattttaaaaacatttgtaggagaccttgaattcgtaaccggcgattatcttattattccgagaggaaccatttatcaggtagaactaaaatctgatgatactgtatttttcgtactggaaagtcactctcctatttatactccgaaaagatacagaaatgaatttgggcagcttctggaacattctccattctgtgagagagacatgattgctcctactttcaaagaacccgttgacgaaaaaggagaattcctgattaaagtaaaaaaagaaaatcagattacagatttcatctatgcaacacacccgtttgatgtggtgggctgggatggttatttctatccttataaattcaatattaaaaactttgagccgattaccggaagaattcaccaaccgccaccggttcaccagaattttgaaggacataatttcgtagtatgttcattctgcgcaagaatgtatgactaccatccacaggcaattcctgctccttataaccactccaatattgattctgatgaggtattgttctacacagaaggtgacttcatgagccgtaatcatattgatttgatggatttcacacttcaccccggaggaattgtacatggacctcacccaggtgctatggaaagaagtatcggtaaaaaattcacagaagaatatgctgtaatggtagaccctttccgccctttaaaaattacagaagaagctttaaaagtggaagatccttcttataaaacttcctggctggaataaatctcaaaaagtattactgactacatacaaaagacgctttaaatcctttatttaaagcgtcttttttcgtaaatttgtgaggtatggttaaacatattgaccatcattatttttcatgacgcatcctaagtaatggtggtttaaaacaaaatcaatattacatgttagaaagaatcagattagaaagtctacgcgacaaagtaaccaccgcggaaaatgcagtaaaaattatcaaagacggtatgaccattgggtccagcggctttacaaaggcaggtgacagcaaagccattttgccggcactggctgaaagaggaaaaaccgaagaccttaaagtcactttaatgaccggagcttcactgggccacggtaccgatggaaaactggcagaagccaacgtcctgaaaaaaagaatgcccttccaggtagatcctattctaagaaacaaaatcaacaatggtgaaattctcttcattgaccagcatttaagcgaaagtgcagagcttcttcacactaaaaaccttcagagcattgatgtcgccattattgaggctgcttatattgaaagagacggaagtattgttcctaccacttctgtgggaaattcggtgacctttgcggctttggctaaaaaagtcatcattgaaatcaataccgaagttcctgaagaagtctatggaatccatgacatttaccaggcagaagattatccttacagaaatgttatcccaattgtagctccttggaataaaatcggaagaaaaagcattcccgttgaccccgataaaattgaagccattgtttttactaaccgcaaagacagtccggcagatattgcagaacgggacgaaaaaacaacagccattgctaaacaccttcttgcattctttgaaaatgaagttcttttgggtcgccttacagaccgcttacttcctcttcaggccggtatcggtaaagtagccaatgctgttctgacaggtttcaaagacagtaatttttatgatctcaccatgttttccgaggtgctgcaggacagtacttttgatctgatcgattccggtaagctaagctttgcatcagcatcctccattaccgtttctcaggaatgttatgaaagagttttaggaaacctttcaaaatataaagacaaattcgttttaagacctcagaatatttccaatacacccggactgatccgaagattgggagtgattgccatcaatacagctattgaattcgatatttatggaaatgtaaactccactcatatcggaggaacaaaaattatgaatggaatcggaggttccggagactttgcaagaaacgcctatctgagtatttttgtgactcaggcagcttcaaaaggaaacaatatttcccatgttcttcctatggtttcacataccgatcatacagaacacgatgtggatattctggtaacagatgtcggattggcagatttaagaggactggcaccaagagaaagagcacagaagattatagacaattgtgttcatccggattataaagaagaattgcaatcttacttcaacagagcctgcgaaaaaggaggtcatactcctcatttattacaggaagccttcagctggcatttacgatttgctgaaacaggaagtatgaaacagaaaacagctgtagaagctgctaattaaatattttcaccaaaagaataaataagaaaaaaggaccggatgtcaatgcatcctgtcctttttttatacaatattcctgcaagttttgcatgacaaaagtcttttcaatatctttaaaatatttgaaaagtatattgttataaagattatctttgaaagaagagctgtattttttatgagatttaaaatacgttgaatacccttttaaaaagacaaaatatgaataattacatcagtgcagaagaagcaatatatacgataaaaagtggaaaccgtgtattctttcacggcagtgcatgtaccccgaactacctgattgatgagctcgcaagacagtctaaccgattgcagaatgtggaaatggtttccattacccagcagggaaatgtagaaattgcaaaaccacaatacaaagacagttttttcatcaattctttatttgtttccacccctgtgcgtgatgctgtaaattctgacagaggtgactttgttccggtatttttaagtgaaattcctattttgttcagaaaaaatattttaccccttgacgtggccctggtaaccgtttcacctccggacagacatggtttctgcacattgggaacttctgtagatatcgccagagcagcagtagatacggcaaaaatcattgtggccattgttaatccaagaatgccgagaacccatggagatgggatgctccacatcagcagaatccacaaactggtttggcatgaagaggaacttccaacggtagactatggctcaaaagttggccctgaagaaatgcttgttggaaagaatgttgctgaacttattgaagacagatccacccttcagatgggtatcgggaccattcctgatgcggttctgaaatgccttaccaatcacaaagacctcggaattcatacagaaatgctgagcgatggtgttattgatttaattcagaatgatgtgatcaataacaaatataaagggtacaacgataataaaaccataacaagcttctgcttcggaaccagaaaactctatgattatgtggatgataataccgtttttgctttcagggatgtaagtgaagtcaatttcccgatcaatatcatgagaaacaaaaagatggtagccatcaattctgctattgaaatagaccttacaggacaggtttgtgccgactctatcggaacacttcagtacagcgggatcggaggacaaatggactttatgcgtggtgccgctttaagtgatgacggaaagcccatcattgccattacggccagaaccaaaaagggagtttcaagaattgttcctttccttaaacagggagctggcgtagtaacaacaagaggtcacattcattacgtcgttactgaatacggaactgcctatctgtacggaaaaaatcttcgccagagagcacaggagcttatcagcattgctcatcctggtgacagagagatgctggagagagcggcctttgaaagatttaaacattgagaatcaaatcataaagcataaaaaactgtttgtgaaactaattatttaaaacaaattctgaactgtacatccctaaaacataaaaaaacattaatattttggcagtatatttgataaaattcattcaaaaacaaggaaattgaaaactatatataattcgatacgggaggaagttataaagcattcgaaagtaaggaattctgttttggggaatgtgaatgaatggaaaagaagccattatattattctttctgaaattattaaagaagaactttccggagctgaagaactgaaaggaggaaaaaaatttgaaatcggaaataccatttcccatgttaccctccagcgattctttgagaatgattaccaggataaaacccacagtgatctcagattcctgaagacccttgataaaatctgtattttcttaggatacaaagatcttaacgattatattcttgccatcagatacagaaaagagaatgaagaggaaaacaatgatcagtcttatcttacgcagatggtgtatgattattgtgccaccgcttttgagttctgcaaacagtttcctgaacacaacaccaacctgtttaaagaactggtttttgatgattccccttttttagagcgggtttcacaattcagcaaagaactatgtgataaagattttcaactggtaacaaaaaataaccggtccaattatgaagtttttgatattcatatcgttaccgatgagccggataagaaaatcctggaaactcaggaattctggaatctgctgttcaaggtaggagaaaccggtgaagaacattttgtgaatcagctgagtacccagatctacttcatccggaaaataaacaatacctggaagatatgggataattacaatcccgatgcgggaatgctcaacagaaaaattgaaaccacttcataagaaagccgtagatattctctacggctttcatgtttcgaaatatttttttttcacttgtattttgtataacaaatgtaggcagacgattttaaactaattaaacttaaatatacttaagtaaactcttctttaagattatgttaaatatattcaatgaaactgcgggaatattttcgccatatctaagaattttgtaatttgcataccaataaaataaaagtaaaagagaaaatatgtcaacacttacatttgccgagaaaatagctcaagcagaaaatttcttgccgattaacggtacggattacattgagttttatgtaggaaatgcaaaacaggctgcccattattacaaaaccgctttcggttttcagtctgtagcttacgcgggtcctgaaacaggagtaagagatcgtgcatcttatgtacttcaacagggaaaaatcagattggtattaacaacaggacttaagtctgattctcctatcaacgaacacgtaaaaaaacatggtgacggagtaaaaattttggcactttgggtagatgacgcttacgcagctttcgaagaaacaactaaaagaggtggaaaaccatatttagagcctgtaacgttaaccgatgagcaaggtgaagtaagaatgtccggtatctacacctatggagaaaccgttcacatgtttgtggaaagaaaaaattataacggagctttcatgcctggctatgaaaagtgggaaagtgattataatcctgaagaagcaggcttgttatacgtagaccactgtgtgggaaatgttgactggaacagaatgatcccgacagtagaatggtatgaaaaagtaatgggatttgtaaacatcctttcttttgacgacaagcagatcaacacagaatattctgctctgatgtctaaagtaatgtcaaacggaaacggatatgcaaagttcccgatcaacgaacctgcagaaggtaaaaagaaatctcaggtagaagaatatcttgatttctatgaaggagaaggtgtacagcacattgctgtggctacaaaagacattatccacactgtaactgaacttaaaaaacgtggcgtagagttcctgtctgctccgccggaagcttattatgatatggttcctgaaagagtgggccatattgatgaagatcttaagaaacttcaggagttaggtatacttattgatcatgatgaagaaggatacttattacagatctttacgaaacctgtagaagaccgtcctactctattcttcgaaattattgaaagacatggtgcacagagttttggtgccgggaatttcaaagctttattcgaagcattggaaagagaacaggaaagaagaggtaatctttaattttacattagaaaatataagttttgtcaggatacagtattctggcaaaacttttttataaaacacagtatatgagaaaatttttaatcgggatttttcttttgggaacactagggcttaaagctcaatatggaactctgaacgaaatccttaaccgacttgaacaaagaaaaggtattaatcagcatcttgagaatgtaaatattgacaacaaaaagttcattttcattaaagacgaagctgatcatacggaaagggactttattgttatcaaagggaataatgctacgtatgtagaagttttcgatgataaggcaaccggagaaagcagttccaatgtattcaccggtgatatcatcaggaaaaaaaatattatttccttaagagcagatatgcttgaaaataaaaaaatcccaatgcctgtcacgaagactttattgctgactcagcaggataatatcctgtacctcattgatgtcaataccagagataggtggatagatgaagcatcttactcaaaaaaggcaaaataaatgttccggggaatttctccggatgatatttaatctaactaaaatctaaacttatgaaatcatttgtagactattcctcaaattcggatttttctatacataatattcctttcggagtcgctgtttttaacaaagaatatatcggatgttgtacaagaatcggagatcaggtcattgatcttgcgaccttatatgaccttggttattttgaagatattgaaggattggacgacaatgtttttgaagcgtataccatcaatgaatttattgaacttggaaaacctgttaccaatgctgttcgtaccagaattcagactttattgcaggaaggatcaattttatcaaaagatcagaaaaccatcgaagaagcattttatgatctggataaagtaaaaatgatgatgcctgtgcacatcccgaattatacggatttctacagcagtattgaacatgctaccaacgttggaaaaatgttccgcgatccggcaaacgcattattacccaactggaaacatttaccggtgggttatcatggaagagcctcctcaattgttgtttcaggaacagaaatcaaccgtccgaaaggccagatgaaacctgcagatgcagataaacctgttttcggtccatgtaagcagctggactttgaactggaaatggcattcatcatcaacaaaaatacagagatgggagaaagtatttctactaaggaggcggaagatgctatcttcggtatggttattttcaatgactggtctgcaagagatattcaatcatgggaatacgttccgctgggaccattccttgcaaaaaacttcggttcatccatttcaccatgggtcgttacccttgaagcgctggaaccattcagaaccgcttctccggtacaggatcctgaagtgttggattatttaaaatttgagggtgataaaaactacgatatcaaccttgaagtatacatccagccagaaaacggcgagcaaaacctgatctgcgaaagcaactacaaacatatgtactggaatatgacccaacaacttgcacaccacaccgtaaacggttgtaatgtagaagtaggtgacatgtatgcgagcggaactatttccggaagtgatccgaaatctttcggttctatgcttgagcttacatggagaggccaaaatcctttatcattaagcaacggagaagagagaaaattcattgaagacaatgatacggttaccatgaaagcatgggctgaaaaggatggtgtgagagtaggctttggtgaagtttcaggtaaaattattccgacactttaatttttatttaaattttaactttgcacaatactattattaaaccttataggttttgaaaacctataaggtttggtgtatgacactgctagaaatatactgttaaacaattagtattagatgtgtcatgctgagcggagtcgaagcacatttttaatatcatttgaatacttaagttaaattaagtgttaaaaccaaaaacatgaaaacagtaatcccctccgagataacctccgtacagctgcagaccattatgcagacagccgtttcaccgcgcccgattgcactggcatctactgtggacaaagacggtaacagtaacttatctccattcagtttttttaatatgttcagtacggttcctcccattctgattttttcaccttcgaggagagtacgtgacaatacaaccaaacataccctggaaaatgttcttgaagtaccggaagtggtaatcggaacagtgaattttccaattgtacaacagatttctttagcttccacagaatatgaaaccggagtcaatgagtttataaaatccggtcttacgatgaaggatgcagaccttgtacagcctaaactgattgaagaatgccctgtcaactttgaatgtaaagttttagaagtaaaaccattgggtgatcagggcggcgcaggaaatctggtgatctgtgaagttcagaaaatccatatcagagaagaatatctgaatgaagacggaaatctggatcagaaaaaactggatatggtagcccgtctgggcagcaactggtattccagaagcaatgaaaacagcctttttgaagtacctaaacctttggtaacaaaaggaattggtttcgatcttctgccggatgccataaagtatagcaaagtatttacaggaaacgaccttggaatgcttgccaacaccgaagtattacctgccaatgacttccattccgatgaaaatattcatcttgaggcccagaagttacttttggaaagtaaaattgaagaagcgtggaaattattaatcagataattgagttgcattcatgaaaaaatatattttctttatctttctattcatagcattacaatcatgctattatccggtaaggaaagattatggcatttacagtaaagcattggtgttttctaaagacaaaaaatggttgattaatgacatcagaacaggggtagactcgcaccacagagaaatgatgggtaaagaaactcttcagctatttcaaaatttaagcagtggtactgcttatgatttaaaaatggcaaaagcggggaacctcattcaaaataatattccatttgagccggaaagtgaagatcttgaggcattgaaaaacaattctgattttaattttctggtaaacatctacacaatgaaggtgcgaaacggtttagacaattccattggaacccagtatgaatataagaaaaatgaaacttttgcaatgatggatgtttatgatattacaaccatgaaaaagatatattctttaaaagcgtattcggaagtttctgtagataaagatcagaaagcaactatttttactcctacgactgaaatgatgactatgaaaaattttagaagtcttttaaaatccgtaaaaaagaatgctgttaaaaactaaagatatctattgataaccaacaaaaaaggagtgaaagtttcactcctttttttattatttggatttaagcgattctgaaacagtaatttttcctttttcagcaaaatctgttaccttaccgtttttatcaatggaaacattcaggttgtcatttttagcatcatagtaaatgcttgtggcatatcccggacagtcgtgctgcttacagcctgtcagtttgtaaattccattctctgatgcgataggaccttccacattgaaattcttcaccatttcatcgtattgggatcctgccagttttttcagtctttctgatatctccttatcttcaaagaatttaatatcatgtggatatttacctacattcttggtgatgatattatcaggagccggggcagaaggaggtggtgatgcaacagaatcgttttttggagttgagacagtgtcttgaggcatcgccgtagtaagagtatccgtagtgcttacagaagattctgttttagtctcttttttacacgaaacaacaaataatgacagcgcaaatgcgcccgcaataacttttttcataatgatattgatatggtgattaatatgttaacgtaattttaaaacctttattttaatttttctttgataaaatcaatacatttttcggttacagtattcagatctttgggtaaatctgcttccgtccatggttctttcgctccgaaagtatgattgccattttcaatcagaaacagttcggaattcgggtggagaatatgaagatgctcagcctgttttacttctacagcctcatcgtctgtcccatgaataatgagcatatgtgcttttgccatttctgtagctctttccacatcaagacggtgaatattctgctcataatcttcataaaactggtaataatgcggcatttcctgtttggtacgcccgttaaccgcataatacactccattatttttccagttttcaaaagcttctccttttggaaaccggtccagagtatcaacactggccaatgtaatcaatccgttgattctttcgtcttcaaaagttttaataatagcaatacctcctcccctgctgtgtcccatcagaacaatcttttcgtcatccacgtgaggatttttactgaagtggtcaattactactccaaggtcagaaagttctctggaataattattattcccaaaagcttcaagatctccaaagcttaacggatcatctgtagttgtcccattatgcgaaaaattaaatttgacaaagaaaaaaccggcttcagcaaatttttcagccatcaggttccaggctccccaatctttataacctttatatccgtgaacaaatattactaagggaagtttttgccctgtgttttgataaaaagcatcggcaagaaaaccttttgtttctttattttccagatatatattcttttcggtaatcagattcataacaaattttcctttccttttaagatggtaatttatgaaaaaaactctgttttccggtctttaattcattatttctttattaaaagtcaggtcaaagtttctaaaaatagcatatttttgtatcatgcagaatttaagaactgtaaccgtgatgcgttacattctgcctctgagagaaggaggatctcttcccgctctggcagaagctgatgatgatttcaaatatgtattaaagttccgtggcgccggtcacggagtaaaaatgctgatctctgaacttttaggcggaaagattaccgaagtattgggacttaaaattcctgaacttgtttttgtcaaccttgatgccgatttcggaagaacggaagctgatgaagaaatacaggatctgctcaagttttcagaaggtctgaatcttggactgcattatctttccggctctatcacctatgatccgggagtaagtgtagatccgcttctggcttcaaaaattgtatggctggatgcattcatcaccaatattgaccgtacttttaaaaatacaaatatgctgatgtggcataaagaactctggatcattgataatggtgcctcgttctacttccaccactcatggcagaattttgatgcagccgctaaaacacctttcaaatatgtgaaagaccacgtgcttcttccaaaagcaaaaatgcttgatgaagcagacaggtttgctcatgaagttctgaacgaaacgttattccgggaaattgtcaatatgattcctgaagactggttgcattggaatgatgctgatgaaacccctgaagaaatccgtgagatctattttcagtttttgaaaaccagattagaaaattctcaaatctttgtaaacgaagccaaaaatgcaagaggataaaatatatgaatatgcggtaatacgccttgtacctaaagttgaaagagaggaatttttcaatatcgggctggtgatgttttcaaaaaaggaaaaattcatcagggtagaattttatttgtgcccggacaaatttaagctgatgcacagcaagctggattacgaagatatcatccataatctggagagctttcagaaaattgcaaatggcgataaagacggcggccctattgcactgcttgatattccggaacgtttccgatggctgacagctgtaagaagcgctgtcgttcaaacctcccgcccacatccgggaaaatccaaagatctggatgctacttttggtaagctttttgaggagttagtaaaataacacatccttaaaaaatttaatatgaatttatcgataaacaacatatcaatttacaggtttttcacaaacctgttttttatttcatttttaagcttttccaatttatttttttcacaagacctgccattaaggccaactaaagctcctgctgtaaaaagcacactacttcccgaaatagcaacagtttcagaaaatattgtttacaaaaccaacagaaaaggccagcctcttgctcttgatctctatactcctaagaacaatactggtgaaaaacttccggtattgatctacgttcatggaggcggatgggtagaaggcgacaaagtggtaaatgccgataattatcttgaaacgactataaaaaaacttataggcaaacaatatgctgtgatcagtatcaactatacgcttctaagtgacagcatccatttcccattgcctttggaagatactaaagatgcggtcagatgggtcagaaaaaatgcagaaaaatatcattttgataccagcaacatcggccttttcggagcttcagcgggagctcatctttctctgatggcagcttatacaccagacaatacttatttgggtaatcctgagctttcatcctattctggtaaggtaaattatgtaattgatcattatggtcctgcagacctcaacaaacttttccacacaagattagggacaatcccggtgggaatgatcggattactgtccaaaaaaattgtcggtttacaggaaaatctggtgaaagggatttcaggatatgatatcagaaaagatcaggacagagcaatagattatcttaagacgatatccccggctaactttgtttcaggtggtgttcctactttaattgttcagggaaataatgataaaattgttcctttaagccaatctaaaaagcttcacagaaaattaaacagggctaaaatacagaattcactgatcatcgttgatggcggtgtccatggttttggtactacagacaaagactatcttgataaaataacagatcagatggttgactttattcttttacagaaaaaataatatacataaaccaatccatgctattattaatattctaaaagtcaatacaataaataacaaaaaatcaaaaatatgctagtttgatatacatattggtattttttattcgggaattaattaccttggctaatgtttaaattatttataataaaatcattaataatttaattatttaccaataaaaatacacaatatggattcattaaacaatatcaatgcgctcaccctcatatttgcttctgttcttattttcgcgatcgcttaccggttctatggtatttttatcgccaacaaagtgctccggctcaatgaccaaaacttgactcctgctgttgaatttgcagatggtaaagattatgttgccaccaataaaaatgtgcttttcgggcatcattttgctgcaatcgcagcagccgggccattggtaggacctgtccttgctgcacaattcggatatcttcccggtgcgctatggatccttatcggatgtgttctgggtggtggggtacatgatatgatcgtactttttgcttcagtaagacataaaggccaaagtcttgccaccattgcttccaaagaaatcgggaaagcaacgggaactgttgcaggatttgccattcttttcatccttatccttacactagcaggattatcattagcttgtatcaatgcaatgcacgaagcttcatggtctctgtttacggtagtcattactatgcctattgcgatcataatgggtctgattatgcgctacaaaaagaacagtgttctgtttgcaagtattttgggaggtattctcttagttgcaggaataatcggagggcacagcctcatgcagaatcctacaatgaataatttattttcatgggatattaaaacaatttccatagcgattcctctgtatggttttattgcttctgtcctgcccgtatggcttcttttggttccaagggattatttatcaacctatttaaagatcggaactattatcatgcttgccatcggtgtaattgttattcatcctaccattcagatgccggctatcacagctttcgttaatggcggaggtcctattataggtggacctgtgcttccttttatttttattgtgattgcctgtggtgcgatttccgggttccatgctgtgattgctacgggaaccactccaaaaatgcttaataaagaaagggaaattcttttcgtaggatatggagctatgctggtagaaggctttgttgcattaatggcacttattgcagcctgcacattgatgccgggcgattattttgcaatcaatacccctaaagaagcttatgactcattccttgctgcgcacccttctcttcacggagtagatattgattattattcgcagaaaataggcattgacctctacggcagaaccggaggtgctgtatctctggctgtgggaatggctcacatcttcaataaaatcccgtacatggatcagcttactgcgtattggtataattttgcgatcatgtttgaagctgtttttatcctgactgctattgatgcaggaacaagggttggacgtttctttttacaggaaatgctgggttctgtagttccgaaattcaatgataaaaactggattcccggaatcattatcagtagtcttctttttacttttgcctggggctatcttgtgtatacaggaaatgtaaacagtatctggccgttattcgggatcagtaaccagctgttagcagcctgcggactgatcgtctgtacaacgatgctgatcaggatgaaccggggtaaatatgctttatgttctgcagttcccggggttttcatggcagggattacgttttgggctggttatatacaggtgacagccatttatatccccaaaggacaatatttactggcagctttagcggtaacggcaatggttctgatgcttattgtgtttatcggagctttcaggaaatggtatcagctgcttcagatcaataagacagagattgatcattatggcgaacctgtgaaggaacttgtggaaagataagattcacattaaattaaaaagaaaaacagttcagaaattctgaactgtttttttataagcattatcggttattaaattaaaaattgaaattaagtcttgcaaaaacatatcttccgttctgtccaaactgagaagtggaacgtgagtaaacgaactgatcattattggtagaagcagaaggtttttcgttggataaatatcaaacaggttattcacacccaaagtgagccctacatttttggtaaactgataggccgcagagatatcagtaatgattttatctccgatctgctgatgttcattaaaatcaatgattccatctccgttaacatcaataatatcagcacctgttacttttccgaaataggtatttctcagatagaagttggcgttcttccatgaaaaggtatgcgaaaggctggctttcactcttggcacagcttcttcaagatacactcttgatttttcagaaaaataaatcttttcaagggaaggagactgcagcagccctgccgaatgaatttctccaacctgtttggtctggttcaggttaattgcgaaattattatccagtttaaatcctgaaaatcttgcattatgtgagatcacaacgtctactccctttgtttctgtatcaatggcattggtaaagaattgtgcagcattgattcctaactggtcgtaagcctcctgtgctttctgtggaacgcttgctcttaagaactggtctgtaagaataatacggttatcaattctcgtgaaataaccgtctgcggtaaagctaagcccagccgaaggaattctgtaagtaaaccctacacttgctgacttggaagtttcctgtttcagctttggcatatccaaaagtcctgctagctgagaatcattactgaaagttcctacttccaaaagctggttatttgtaaataatgtagacgttacattataataaatctggtggatagacggagctctgaatcctgtagaaccggcaaatctcacattgaaatccgatgtgactttgattcttgatgctaatttataattgaatgtcgatccaaaatcagaatagttttcatatctcgccgcagcatctaccaatagccagttggtaaagttaaattccacatccgcataggctgctaccgactgtctgtttttatctactgcatttccgggcttaaatccgttgaaaacctgagaacctcccggaagcgatgctccgaaaaaatctgtaggtcttacagaatttccgttccaaacatttcctgaaacgtcatatgttgcataagaagcttcttctccctgggtaattttaaaattttcatatcggtgctcacctccaaaggctacattgataccttcccacacatcgtattttttagagaaatctaaattgatcgtattttgagaaaaccttaagccacctgcattgaattcccttggtgaagcaaagcgcagagaggtattgcctgtattctgaatattataggtaaatgaattctgcccgtaagtattactgaaatcaatattccagccgtcccatttcccttttattcctgctgctaatgaaatatcctgaatatctgttccgatttgtggaagataaccattgggatataatcctgtaaaagttctgctttcgcttggtcttctgtaaaaccctccggaagttccatgtcttaaactgtatcctccaaaagtgtatactttccagttttcactgacaggcacttcagcatttacaaacaactgatgattattaagttttgactgtcctacctgcatattaaaatcctttctcgtctgacctctgtaagccagttcctgatcagtaaagtaattaagctgatctctggtaaagctcgaagatttcaagacattctgtaacgcagagatggtaccagctccctgaatcgcattttgtaaatccggagaaaaatagcttacattctgtgcatactgatgaatgtaattcacgatctgctgtgaattgggtgtattatttatattggtaaaaagagaagaaaggtttactccgtcatttaaagcacgttgttcaattgcattataagcattataaataggtccactttctgttcctgctctatacgttggatttctgaactgtgacgaccaggtaatattaaagaatcctcccttggttccgattttatttccataattcaaatccagctgaatattttgtccgtcaaaatctccggtatgatcgttagctgttggcgtaaggtttcctccgtagctgatctgacctgcaagttttcctgtatctcttttaagatcaaggttaatgacacctgcaatggcatcagaaccgtattgagctgcagctccgtctcttaaaacttcaatcctgtttaaagcaaaagatggaatagcattcaaatctgtaccaacagttcctcttcccggcgttccgtttacattcaccaatgctgaagtatgtcttctttttccattcactaaaaccaaaacctgatctggtcccaatcctctgagctgtgcgggatccaagtgatctgtaccatcagaattggtttgaatggtggaagtaaatgaaggtgctaccgcgttaaggatttgccctatattcgtctgcggaagaatgattgaagattcttttacattaaagacatctacaggaaccgcactttctgtcttagatctggcaccagctcttgaacccaataccacaacttcttctacattattggtttttatactgtctttatttgtttttatgctgtctttttcctgtccgtaagtaaatacaccaaggaaaaataaaacagaggccgaaagaatagtttttttatttctcatatagtttagaatttgataacatttatgttttttacaaggtgcaaatgtaaaatttatttattagtctacaaaacagatagactttgtttttataaaaaatagttatcgtttctttctatccctcacttaaagttaagataaattaaggaaatatttataaaaaacgttgttttatagcaggttaaatttaaattgaattttataaaaacgctacgcacgcaaagaaatcttttacttattgattattttttggtcgcaacgcacttcgttcagcagaggatttatcttagctaagtgaacgccttcgcgaacgaaaaaatgaaacagttcaaatagaacagaactctgcgaacttcgcgtttaaataaaaaaacggatccaaaattgaatccgttttctttatattattttatgataaaattaaatcttagtcagttttgcatatttcaggatcaggtttttctctccttcatgcatgaaaactacttttgctttgatattctgaggatcagttccgtccaggaaagtgacttctcctattccgaaacggtcatgtctcactttatcacccacttcaatatcctgagacgaggctccgcttggattgataattttagccgtgctaacaggtttcagttttctaacttccgttgccggttttgaagtctctcctctatcgattgtctttttttcaacctttttgaaagatctcatttcggaaggatgttcatcaaaaatattggactttacccctgaattattgataaaccttttttccatagcaggattaaggaattcaatatattcatcatcaatttcacttaagaatcttgaaggttcagcgtcggtaattttcccccattggaaacgggaaacagcatatgagaagaaagcttgtttttctgcccttgtcaatgctacgtagaataatcttctttcttcttccagatcttctctggtagccgaactcataaagctcgggaataaattttcttcaagtcctaccaggtgaaccaccgggaattccagccctttggagaggtgaatggtcatcaatgaaaccatatcatcttccagttctttatcctgagtatctgcagaaagggcaatattttcaaggaaattggaaagactcggatcaccgtcttcaagctgcatctgttcttcaatgaatccctgcatagagttcatcaattcctgtacgttttctactctggaaattccctcaggagtctgatcatctttcaggaatttgattaaaccgcttcgttttgccacttccatagcaacactgtaagcggtttctgttttcaatagtacctgaaaagccttgatcatggaccagaaatcattcagtttatttaaaactccgttgtttaaacctaactggggtgcatacattggaagattatccaacacttttgaaactgcgatattgtgagcatctgcaaaaacaatcagtttattctgtgttgtttctccgattcctctcgccggataattgataatcctcatcaatgcttcagaatcgttttcattgataaggaggcgaaggtacccgataaggtcttttacttcttttctctggtaaaatgaaagtcccccgtaaactttgtacggaatatttttacgtctcagcgcatcttcaaaggcacgcgtctgagagttggttctgtataaaatagcgaaatcgctgtactttctctggtcacggttacgaagttcccagatatttcctgccacgaaattggcttcatcagcatcggaaagcgaacggtatattttaattttgtccccttcttcattatcactgaatacattcttcttaaactgctgcaggttttttgcaatcacaacattcgcagcatttacaatattctgtgtagaacggtaattctgttccaaagataccgttttagcatccggataatcttttttaaagtttaagatattataaatattcgctccacggaaagagtagatagactgcgcatcatctcctaccacacaaatattttcaaattttgaagccaatgcttttacaataaggtattgagagtggttcgtatcctgatactcatccaccataatgtatctgaatctatcctgatattttgccagtacttccgggaaacgggttaaaagttcattggtttttagcagaagatcatcaaaatccatggatccgtttctgaaacactgctcaacatatctttgataaatctgcccgatgaacttcatattcgctttttcatcagcttccatcagttccggattattgaaatatgcttttaccgtaatcagattattcttgtaggttgagattcttgcctgaacttttttaggtttataaagatctgcatcaatattcatatccttcagtacctttttgatcacattcaaagcatcctgctgatcataaatggtaaagttggaaggataaccaagataatgggcttcaattcttaaaatcctcgcaaaaaccgagtgaaaagttcccatccagaggcttcttgcattgctttcccccacaacttttgcgatacggtctttcatttcacgtgccgctttattggtaaaggtaagagccaggatattgaaagggtctattccgttgtgtattaagtgggcaatacgcatggtaagtacacgcgttttcccggaacctgctccggcaagtaccatcagaggtccctgtaaagaggtaacggcttcatattgtgattcgttgagtcctttcaaatagtccatacagcaaaaattttgggaacacaaaattaaggtattcggaggagaattcaaactctcataaagaagttaggagtatgaagtattaagattgtatttgtcaatggtcaattttgctccgcaagtgaattgtgaaggattattcttggtctcaactcccgcaaccctaatcacctaacaaattgacaagcgaagcgaattcactattcgccattcactattcaccatcacctatatatttctacatattctgtaacatttaattcacttttcatactaataggtaaacaatttctaaattttatgaaaaagcgacttctttctgctgctgccgtagctttcttcgggctaatgctgaacgcacagcaaattaaattcgaagagtatgaccttcccaatggtcttcatgtaattcttcatcaggataactcagcaccggtggtaacaacaggtgtaatgtaccatgtaggtgccaaagatgaagtaaaaggcagaacaggttttgctcatttcttcgaacatcttttattcgaaggaacccctaatatcaaaagaggagactggttcaaaatcgtttcttcaaacggagggcagaacaacgccaacaccaccaacgacagaacgtattattatgaaacattcccttccaataatgaacagcttggactttggatggaagctgaaagaatgcgtcacgcagtaattaaccagattggtgtagatacgcagagagaggtggtaaaagaagagaaaagattaagaatggataaccagccttatggaaatcttttcaccacaattcagaaaaatttatttaccaatcacccgtacaactggccgacaatcggttctatggaagatctgaactcagctaagctagaggaattccaggcattctacaaaaagtattacgttccgaacaatgctactttggttgttgcgggagatatcaaacctgagcagacaaaaaaatggatcgaaacgtattacggaggaattccaaagggaacagtatatcctaaagatttcccgaaagaaactcctatcactcaggaaaaagaagtaactgctactgacccgaatattcagcttccggcttatgttttcgcgtacagaactccggctaacaaagagaaagatgcttatgttttagatatgctttcttcttatttaagtaatggtaaatcttccgttttatataaaaaattagttgaccaggataaaaaagcacttcaggtagctgctttcaaccagggtcttgaggattacagtatcttcgcattcttcgcgattccgatgggacagactaccaaacaggttctacaggcagatattgatgctgaaatcaaaaagcttcagactactttaatttcagaagaagattatcaaaagcttcaaaaccagtatgaaaaccagtttgtaaatgctaactcgagcattcagggaattgctgcttcattggcaactaatcatgtattgatgggtgacacgaatcttatcaacaaagaaattgacatttacagatccatcacaagacaggatcttcagaatgcggctaaaaagtatcttaattccaaccaaagaataatcatcaactacgtacctgagaaaaagtaatcattccattttttcaggttaacctatgattattaaaaattaaatttttacaaatgaaaaagcaattaacatatatagctgcagcgtttttctttacaggaatggtttcagcacaaaaaatagatcttaatgcaatgccaaaaccaggacctactcctgcgatcaacattgccaagccaaaaacatttcagctaaacaacggccttacagtgatggtggttgaaaacaacaaactgccaagagtaagcgcaagtctttctatggacagacctccatacaacgaaggagctgtaacgggtgtaagcgaaattatggccgaacagttcgaaaacggaacaaccaacatgagcaaagatgatttcaacaaaaaagtggattatcttggggctaaccttaatttctcttcaggaggtgcttctgccaactcactttcaaaatatttccctgaagtattaaacttaatggctgatgccatcatcaatccaaaattctctgcggaagaaattcaaagttctaaggaaagagctatcgaaggattaaaatccgacgaaaaaaacgcatcttccattgcttcaagagtttccaatgctttgatgtatggaaaaaatacttctagaggtgagtttgaaacggttgaatctatcaacaaaatccagcttgctgacgtacagaatatatacaaaaaatactacgctccggacaatgcttatctggtaatcgtaggagatgtaaagtttgatcagataaaacctctgatcgagaaagctttcagtggctggaaaaaggcaaatacacctgttaccccactagaaccggcttctaatgttgctaaaacagaaatcaacgtagtggatgttccttcagcagtacagtctgttgtttccttaaacaacctgaataccctgaagatgaaggatgccaactacttccctgcaacaattgccaactacattcttggaggagggggtgaagccagacttttcatgaaccttcgtgagaaaaacggattcacttatggtgcttattcaagcatggttgcaagtaaatattctccacaattctctgcaagtgcaagtgtaagaaatgaggttacagacaaagcagttaaggaattcatgaatgaacttaatgctatttctactgtaaaaccggaagaactggctaatgcaaaagcaaaactgaaaggagctttcattatgtctttggaacagcctgcgacgatcgcaagatttgctttaaatcaaaaggttcaggatttaccggctgatttctataccaactacttaaaatctattgataaagtaacagcagcagatgttaccaatgctgtaaaagctaccatcttacctaaccagagcagaattttcatcgcaggtaaagcctctgatatttctgaaggactggaaaagctggggtatcctgtaaaatattttgataaagatgccaatcctgtagcgaaaccaacggtacagaaagtggatgccagcgtaactgttgcatctattgttgacaaatatatcaatgccatcggaggaaaagctaatcttgcaaaaattacttcttacaccacaaatgcttcaatgtctatgcagggacagaatatcgattttaaaatcgttaaggcacaaggaggaaaagaacttactactgtaacagcaatgggtcaggttgttcagaagcaggtatttgacggaaaaacaggttattctgagcaaatgggacaaaaagttgccatcacgccggaagaaattgctgaaaaacaaaagaatcctgagctttttgaagaattaggcttcacaaaatccgctgattataaattaggaggaattgagaaaatcggaggcgaagattcttatgcaatcaaaggcggagatacaacgtattactacagcgttgcaacaggattgaaaaccggagaaactaaaaaagtaaaggctaagggtcaggaaatgactatcccaacaacattctctaattacaaagatgtagaaggcgtaaaaatgccttacaccatctctgtaagccagatgggaatggatatgaccatgacggtaaagtcttatgaaatcaataaagcaacggatgctgattttaaataacaacatcctgtttttataaaaaaaacggtaacaattgttgccgtttttatttttatcaacatttggcgacatctttttttgccattcagtaaaaaaagattaaatttgcccattcaaaaagatatcggaattaatggatactatatttacactattgatggttcttattatgattgccagtgttttattggtaattatcgttatggcgcaaaatccaaaaggaggaggcctttccagtacattcggaggtgcatcatctgcacagttcggggtacagagaaccaatgatttcatggaaaaagcaacatggactctgggcggaactatcatcgttcttatccttttaagcgttgttattacaggtaagccttcacaggcacttcctcaacagccagcgaagaaagaagctcctgcaaaacagtcagctcctgcttcttctacaacaactcctgcacagactcctgcaccggtaaaataagaagaacattatcataaaacaaaagcaactcaattgagttgcttttttattttaacctgatcttttcaatctgatggcggagcttcaatcctgctttcaaaaatgaatattgtacaggtttagattctttataatacttgtcaataaagatctgcattgctccatagaatctgctgagatatacctcatctttaatggtactttcccctttatggtgaagaattgaaacctttccgtaatagaagtttttatatccgtttcttaaaaaggtatagcaaagatcaatatcttctccatacataaaataagcttcatccagcccgcctattttttcgtacactttttttttagccaataaaaaggctcctgtgatcacatcaacttcagctacctcattttcttctatatcgtttctgtaataggattttgaattgttctttttaaaattggtaaacagtttttcaaacgaattgaacatatccggaactgagcgtttactttcaggcaaaaaatttccttcagcatcatgcatcctcactcccagacatccaaaggaaggctgtgcatctgcaaaatccagcaattctttcatataaaacccttcaagctcggtatcaggatttagaagtaaaatatattctccttttgccgtccggatggcccgattgttcgcttttgaaaaaccaccatttgtttcagaagaaataaaatgtatgttgggaaattcagtaataagttcttgccatgaagcgtctgtagaagcattatcgatgacaatgacttcatattctatctccaggatatatttctgaagcgactggaggcagcttctgagcagttgggtgacattgtaattaacaataataacagacagcttcatattaatctttctcgttgtatggcaatctgttgataatagatcttcctaaagaaatttcatcggcatattccagctcgtctcctaccgaaattcctcttgcaatgcttgaaaaattaacattgaagtttttaaatttcttataaatataataagctgtcgtatctccctccatcgtagcactcaacgcaaaaataaattctttcaccttgccttcattcagctttttttcaatgctgggaatgttcaactggcctggtccaactccttccattggagatatttttccgccaagaatcagatatttccccgtgtacttccctgtattttcaatagcaatgacatcacgcacatcttccacaatacagatcagttcgccatttctcttttcattgctgcatatttcacaaacgtcaaaatctgaaaaattatgacattctttgcagtatttgatttcgttgacaagattaatcagggagtttccaagacttacggctctggaactgggctgcttcaacaaatgtaatgctaatcttaaagctgtttttctaccaattccaggcagcccggaaatctcatccaccgcctttgccaatactttactagggtaatccataagtacaaaaataaggattaaagttgataatttacagtgaataatgaatcgtcgattcgcttcgcatgtgaattttcatacaacataaataaattttaacgcagtgttcactaagatttttttaattcttaaaaacgatagcgggggcgtttcactcagcaacagacaaatctgatatcctggttgaacgaagtgcctttgcgatcgaaataaataaaaataaatatcaaccttgcgagcatagcgtttcttttaacaaaaaacattttcaacacaatgtctcattatgatattttatatttctctcctgtctgagaactgtaaaaaaacctttatatttgcggcttaaattaaatatgaaaaaaataaactgacatggtacttaacaatcttaattatccactggatttcaaattcaaaatcactactttagcaagcgacttcaacattactgacaaaaatggaaattatgtggcgtatgttcgtcagaaaatgttcaagttaaaagaagatgttatcgtttttaatgatgagagcaaatctaaagagcttttcagaatcaaagcgaatcagtggattgatttcaacgcttcgtattctctgaatgatcttattgataacaaaaactatggcagactggcaagaaaaggtatgcgttctctctggaaagcaagctatgatatccttgatgcacatgatcagcctaagtttaaaattcaggaagacagcgcatgggtaagattctgggacagctttgtaggagaaattcctatcatcgggatgttcaccggctattttcttaatccatcttatacagtaacgggtattgatggtaaagcttattttaagctaaaaaaaatgccgtcattcttcggaagaagattccagctggacagactgattgacattgatgatcaggaagaaagtttagtgatcctttctttactaatgatgacgcttcttgaaagagcaagaggataaaccaattataaaaccacaaacaaatgaaatatttaatcattttattttctgcatttctgctggtagcctgtaaaaaggaaaaagaaactgtttcagattctgctcctgctgattctttacatgtcactaaggactctgcttccactgctggtatttcttccggaaatatcctggtgggaacaattccgtttccaaaagaaatcaaagaatgttcctgctattttgctgtaagcaaaactgattttgaaaatgaaagatacatctacgcagatgacgccggaaagaccgcttatatgatgctggacggtaaaagactcgctatgaatctgatctcatcaagcgatatggaagtagatgaattgcttaccaaagaaatagaaaatgatgattataagatttctgtaaaaggtaaaaaaataaaaggcgaagaagctctgctgtttgaaggtactctgactattgagaaaccagacggcaccactttcacgactcctatttatggagagtgtggatgctgataaaagcgaaaaagcccactcgcaaaaaggtagaagcgaaaaaaaggatcagcccatttgctgttttgctatttcgtctccaaatgcatacaaagtgcttctgtattccacagaagcattttttattttgtaaatttgggaaaaataaatttcaatggaattatctaatatagaaccgcagatcatctggaaaaatttttccagattaaatgctgttccaagaccttcaaaaaaagaagaaaaagtaattgctttcatcaaaggatttggtgagaatttaggactggaaactacggtagatgaagtaggaaacgttattattaaaaaacctgccactgcaggaatggaaaaccgtaaatctattgtgcttcagtctcaccttgatatggtttgccagaaaaacaatgatgttaatttcgattttgaaacagaaggaatcaaaatggaaattgacggtgactgggtaaaggcaaaaggaactacactaggagctgataacggtttaggagtagcaaccattatgtctatccttgaaagttcagatataccccaccctgcattggaagctcttttcactattgatgaagagaccggaatgacaggtgctttaggattaaaaccaggacagttaacaggtgatattctattgaatcttgacactgaagaagatgatgaaattgatatcggctgcgccggtggtgttgatgtaaccatcactcaaacttaccctgcagaagcttcaaaaggacaaattgtaagacttgaagtaaaaggtcttcagggaggacactccggaatggatatccataaaggcttcggaaatgccaatatcattttgggaagacttctttacagcggattggaaaaccagaacatcgaactggtttctatcgacagcggagggttgagaaatgcgattccaagagaaggtgttgccgttatttcggtgagaaatgctcaggagtttattgaaaatgtaacggttcttaaaaaagatattttagaagaattcgcaacggtagaacctggaatccagattaatattgagagctctacatcttctgacaaggcaatttctgaagaagattccagaaaagtgatacttactttaaaagcgcttcacaacggagtttacagaatgagcccggacgtaaaagatcttgtagaagcttctaacaacgtggcaagagtagaactgaaaggtggagaacttaagatcttaaaccttacgagatcttctgtagattcttcaaaatattcagtagcggaacaattaaaatctgtagcggaactggctggaatgaatgttgagttcagcggttcatatcctggatggaaaccaaaaccaggttcagaaattgtacagctgatggataaactttacacagaaaagttcaatgaaaaacctcatgtagtagcttgtcacgcaggacttgaatgtggaatcatcggtgctaattatcctgaaatggaaatggtaagctttggacctactatcagaggggcacactctcctgatgaaagagccaatattccttcagcacagaaattctggagcttcctaaaagatattttagcgaatattcctcagaaataaaacattaaaattactatattgaatatccaaagtcttatgattttggatattttagttttaattgaaataaagatgcttcgacaggctcagcatgacgctgctaaaaatttatctctaaaaaagcagttagtattagagatgtcatgctgagcttgtcgaagcatctcaacaatagcataaaaaacaaatctaatacaatgaaaaatatcaccgtattctgcggctcaagtttcggcacagatacaatctatgaagagcaggcatttttgcttggccagactttggcaaaacaaaatatacaattaatttatggcggctctgaaaccggtttaatgggaactattgccaacggagtattaagcgaaaacggcaaggtaacaggagttctcccctattttttacaagctaaagagattgctcataaaagccttaccgaactgatcctcgtggaaacaatgcacgaaagaaaaaccaaaatgaatgaactctgtgacggcgttatcgttcttcctggcggctatggtacactagaagagttttttgagatgatcacatgggcacagcttgggcttcataaaaaacccatcggaattctaaatattgacggattttatgatgatctgatcaggttggttcaaaccatggtcgacaagggatttttaaaacaggtgaacagagatatgctgctgatcagcgataccattgatgaactgttggaaaagatgagaaattaccaggcgcctacggttgggaaatggatttctaaagatcaggcataatcacaggaagaatatattgaaacattcgctctttttaaaatatgttttcatatctgaggtttaagtttagtacatttgtgagaatactttctcacgactaaaagaattaaaacaatgaaaaatggacttctgacaggctgtatattattaagccaggtcatttttgctcagtataattatcctaagactcctgaaaatcctgtgacagacgattactttggtaccaaaatcacagacaattaccaatggttggaaaacctgaaaagtcccgaagtacaaacatggttcaaggcacagtcagatttcagccataatcttattaataccattcctaatcgtgatgccctgtatcaaagaatgaaacaggttcaggaacttggtggagattcctacggctatgcaaagcaaagaggaaatctttatttctatgctaaaaccaaaaaaaatgaaaagctttccaagctctacgcaaaagacgtttctacgggaaaggaaactctgattttcgaccctgaaacctataaaaaggatgcacagattaccgatttcacagtagactccagcggtaataaaattgctctgttattttccaagtccgggagtgaaatttgtgagcttagaattttagatctaaaaactaaaaaattccttaatgataccttatcgcccatctggagcgaatttaattttgaatttactccggatggacagtatatcacctataccaagatgagcacgggagatcctaacagcaatatgttgctgaaagaaatgaaggcgatgcttcatcagattgggaccagtcaggataaagacgttatattgggatcacgtgaagaatatccggaacttaatatcttaacagaacaatttcctgaagtatcttttacaagtgattaccaaaccatgatcttaagaatcggatccacaaaaagcgaaaaccctgttttttatgctccgatatcttctcttaaagataaaaaaatcaagtggaaacagatcatcaaaccatcggacgagattgtacagacattcatcagcggagatcaattgtttttccttacgcataaggatgctcccaattataaagtagggctgacaagtttatcaaatcctgatttcggtcatgctaaagttattgttcctgaaagcagttctgtcatcacctctatccacagctctaaaaattatctgttctattctttaagcaacgggattacccaggataaatatcagatagatcgtaaaacactggctataaccaaaattcctctacctggtgggattaataattctatcgctcttaattcccgtgaaaatgataatctgcaatgctataacagcaattggcttactcctggcactttttatgattataaccccgaaagtggtaaagctgtaaaaagcaaatattttaacggagacagcaactatcctgattacaatgcactgtatgaagtaaaagaagtggaagtaaaaagtcatgacggagcaatagtacctctttctattatttatcctaaaaacatcaaaatggatggcagtactccagcttatatcacagggtatggcggttatggaatatcttatacccctcgtttttccactagattatcagtattacttgaacaaggtgtagtactggcaattgcccatgtaagaggaggaggcgaaaaaggagacaaatggcacagagacggaatgaaagctaaaaaacctaatacctggaaagattttatcgcatgttccgaatatcttgtgaatcaaaaatatacttctccctcaaagcttatcggcaatggggcaagtatgggaggagttcttattgggcgggctattactgaaagaccggatttatatggagttgccatcgccgaagtaggaatgaccaatgttctgcgttcccaaaactcagctaacggagccaatcagattccggaagtaggaaatttaaaagatcctgaagacaccaagcaccttattgaaatggatgctcaaagcaaggtaaaaaaaggcgtaaaatatccagctgttcttgtgagtaccggaatgaatgattccagaattaccccatgggagcctgcaaaatttgccgctgcattacagaacagtacgtcttccgggaaacctgttttattatatgtgaattatgaaaacggacactttacaagtgatctggaaataactttccgtgaatatgcagatatttatgcttttgcattatggcaggtaggccatccgaaatttcaacccgaaaaaaaataaagcaaaacccgtccgaaaaaactcggacgggtttcttattaagattaaaaaatattttctaaggataaggagcaatctccacttcaagtccctccatttcatcagcaatatgcagctggcatcctaatctgctgttgtctttcacgtggaaagcttcagccaacatcgcatcttcttcatctcccattggctctagccccggatcattgattacataaacctggcacgaagcacacatcgccattcctccgcatacaccaatagtaccttcttctgccaattcataggaacggataatttccattaaattcatagacatatccgtaggagctacgacatcgtgggttaccccttctctgtcggtgattttaatattaatatctgacataattctgcaaaattagtcaatttttttcacaacagctttctctgcttctttacggcttccgtcaaatccgtctactccacttaccgttgtatattttaaaacgaattttttacctggattcagtctgttgtaaacgctctggcacattaaagtagcctcatggaaaccacaaaggatcagcttcagttttccagggtaagtgttgatatccccgatagcataaataccatcaatgttggtctgataatcaagggcattgtttacaacgattgcatttttttcaatatttaatccccagtttccgatctctcctaattttggtgtcaatccgaataaaggaataaaataatccgtttcaatatcgtaagcttcctgaccttctacttctaccgtgatagcctctacttttccgtcacctttaataccggtaacttctgcaggagtaattaatttgattttcccctgatttttaagatcctgaactttctctacagaatccaaagctcctctgaactcatttcttctgtggatcaaagttacttcgctggctacattagaaaggaagatactccagtcaagggcagaatcacctcctcctgcaataactacttttttgtttctgaagtgctcaggttccttaacgaaatattcaagacctttttcttcataatcagctatattttcgaaagtgggctttctcggttcaaaagttcctaatcctcctgcaatagcaatagctttacatctgtgaacagtacctttgttggtaatcacttcaaaccattcatcatcaacttttgtataagaaacagccgtctctcccaaagtaaaccctggttgaaactgcttgatctgctccatcaaattatctaccaattctccggcatttactgaaggataacctgggatatcgaagataggtttcttaggataaagttccgccaattgccctcccggctgtggaagtgcatcaataatatgacacttcattttcaataaaccagcttcaaaaactgcaaaaagtcctgtaggtcccgcacctatgatcaatatatcagtggttatcataatctttaagataatttaattatacatgtaactgcaaatttactaattttaatgcgaagcatatttaattgattctaaataaaaacctgagatttgtcaaatatctatcaattaagattttaaatttggcaatgtttttgtaaatgtcttgttatgaagaaaattttaaacctttttgcagtatttatattctttttaggctctgcccagattgataacatcgcagacggcgaatctattactcttaggattcactacggcttcctgaatgcaggaactgcgaatcttactacaaaaaagactaactacaaaggggttcctcatctctatgtgaaaggcacagggcagacaaccggtgctgtaaaagcattcttcaaggtagaggatttatatgaaagcttcatcaatacccagacaggattaccaagtttttatgtaagaaatgtacgcgagggaagctatcggcaacattttgaaaccgctttcaatcacgataataacactttgattttaacggataaaaagacaccggccaatgggtctaaagttttaaaatcagtgaaaggtgtacaggatatgctttcatgcttctattatttaagaagtaaaagcccggatgaactcaaagtaggaactgtgatcaatatgaacgtatggattgatgatgaaatgtttccgttccagctaaaagtgattggaacagaaaatttaaagactaaattcgggaccatcaattgtttgaaaattatcccatctgtaaaaagcggaagggtatttaaagaaaaagagggagtcaccatgtgggtttccaacgatgctaaccacattcctatgctgttgaaagcggaacttgccgttggggcactaaaagccagcattgatgattataaaaatgtgaagtatcctttaaagtttagtaaataacaacatttgtttcaatagaaagcctgtaaaactacaggctttttttatttccaatgtaatatactcctaagattgattgtcttaattatagaggcagtcaaagagctgcagcatgtcaatactgaggttccatccaaagtatgggcataagaaacagacacgtgtaaatttttcaataagatcagtttttagttacgttttgtttcttaggtcagtaattaaaaacaaaaaacctccggagctccggaggtttgattttttatagtgttttgaattgttcaagtgttctgatatcattttcaaagaacattctgatatcactcatctggtaaagaagcatcgtaattctttcaattcccattccgaatgcatatcctgaatatttctcagaatcgatattcacatttttcagtaccgcaggatctaccattccgcaccccatgatttccagccatcctgttcccttcgtgattctgtaatcagtttcagagtttaatccccaatacacatcaatttcagcactaggctctgtgaacgggaagaaagagggtctcattctgattttagattttccgaaaagctcagtagtaaagaactgaatggtttgcttcagatctgcaaagcttacattctcatcaatatacaatccctcaatctggtggaaaatacagtgagaacgtgaagaaattgcctcatttctgaatactcttcccggagataaaattctgatcggaggctggttttcttccatataacgggtctgtacggaagaagtatgcgttctcaaaagaatatccggattctgctcaatgaagaacgtatcctgcatatctcttgccgggtgatattccggaaggttaagcgctgtaaagttatgccagtcatcttcaatctcagggccatctgctactgcaaaaccgatagatttgaagatttcaataatcctgttttttaccagattgatcggatgtctggaacccagatccaatggaaaagcgggtcttgtaagatcttctttttcaacgataacagaagatgctgaagcatttttcaaatcctccagttttacagccaccgcctgctttaaagtattgatcttctgcccaaattctttcttctggtcattaggaacttctttaaatttttcaaaaaaatcattcagaaccccttttttaccattgtacttgattcggaagttttcgatctcttccttagaggtagcattgaagccgtttacttcgatcagtagttcttctatcttttctatcattgttttaccctttcaaaatgttttgcaaaaatacgattttaagttgaataataagtccgtcataaaaaaatctgcctctttttcgggaggcagacttcaatcacttatttcacttaaataaaaaaattatttcttttctaaagctttaacgctgatctgaagagttacctcatctttgatcacaccgttttcagcaggagcctggaacttcaccccaaactcttctcttttgatatctttcggctcagtagctacgctcacttctccattcttcacagaaacattagctttaaactgaacaggttttgtaattcccttaatcgttaaattaccatccaaaagcgtattataatcaccttctgtagccggagttacttttgtaatttcataagaagctgtaggaaatttttccacttcaaagaaatctccgctcttcaggtggccgtttaattttcctaaatcttccggactgtctttaagatcaacagaagttaaagaattcatatcagcaacgaattttccgctttccagttttccgtctttcaccgtcacatctccgctttcaaacctgatcgtaccgaaatggctcgtattttcagatttaaatactttatatcccttccattcaaccttactgtttagtgtatccaaagtgaactggctaccttctttagtagtcgtcacctcattactttcactggtaagcggtttatcttttttacaagaaaccattacagcagcaataaataatgcaggaatagctaacgaaagcagtttttttctcatttttgatttatttttattagttccgctaatataataaaaaaaaatatgttttcataaaaaccttacatttgtaatatgctattagaaataaacaatttatttttctctcacaacaaagaaaatcccctgtttcagaaccttaatctaaggtttgaagaaaacagaattatagctcttgccggtgaaagcggatgtggaaaatctacccttctcagcctgatctatggccttcttgattgggagagcggagaaattatttttaacggaacaaagctttcaggaccaaagggaaaccttgttcccggagagcccgaaatgaaattcgtggcacaaaattttgatcttatgccttacgctactgttgccgaaaacgtaggaaaatttatttcaaatatcaatttaaaacaaaaaaaagaaaccgtaacggaacttcttgaggtggtaggacttcaggaatttgccaacgtactgcctaaatatttaagtggcggacaacagcaaagagtggctattgccagagcattatccgtacttccaaagctcctgattttagacgaaccgttcagtaatcttgatttcccgagaaaaattgaaatccgggaaagacttttcaggtatgtaaagcagcatggtgtttctttaattatttccacccatgaactacaggatattatgccatggctggatcagattgttattcttcaaaacggaagacttattcagaatgacagtcctgaagaaacctacagacatccttacaattcttatgttgcgagactattcggggaagtgaatatctttaccgaaactgaggcagcagatttccagctttcaaaattttcatattatccaaaggaaataaaaattaccgaaaccggtgttgaagctgaaattctggaaagcagatttgcaggaaattattattggaacaaactaaaagcaaaaggtaaagaactggtagtttatactgatgataaaatatccggaccaatatatatttcttttatttaggctaaaaggctaaatcgcaaaaaagacgaatagaaaaaatcctgaaacagattatcagactgactatgaatccattttgctatttcacagttttgccattttactacctcatctaactcctacatttccttacacttacccataaaaaaaatacaaagataagaagcggttataaaactttttcttacatttgtattccacagcataaggaaatttttggttaattctctttctgccttccggacggacattagcagtactgcaattaagtctcttgaaagattacactgtccaattttttccttttcttatttttatgggtataaaaagcaaagcaatcttacgctttctttacaaattctgatttaagagccatcgctccgaaaccatcaattttacagtcgatattatgatcgctccctggtcttaaacggatatttttcactttggttcctgcttttaccggctttggagctccttttacaggaaggtcttttactactactacagaatcaccatcctgaagttcatttccgttagagtccaatatctttccttcatttgcagcttcagaagcagcttcttcagggttccattcgtaaaaacactgagaacataccatcatgttatcgcttgggtaggtaaactcagagctgcatttcggacaaagtactgtatcactcatattttaattttttgcaaaggtagggctttttaaaggttgaagtcaagaggtaaagcccagtatagtagacaataagcacatgttaatttcacaccaccaagtgaattagtacaaattaaataaacctgtcgcaaagaaaataaagtataataatgaagagtgcatattttgctagcaaatatttttcattaagcaaaaatacaggtttattcatcgtagagtaaaaagctattgtaaacaaataaaaaatataaatattcggaaaatatttagaaattcagcattaaaatttatttctaccatctaaaaaattaataaatataatgaccattcactactggatctcagattgtcaatagtcaatttttgctttgcaaagtgaattgtgaatgcgcaaccttttattagaaaactgatttgtacaatatataattactcataacctctcaaccggaaaccgaaaattcacaagcgaagcggaattcactattcactattcaccatccaggatccccttcacctctcctattctcaatctctctactcaaatcttcaactctcaattaaaagtcgtatttttgcagattcaaacagcgaagcaaatttatggaacttattcacagaaacttggcaatcggaattcacgatgccttacaggagacattttttgagaaaaacaaatatgccgataaagttattgaaagacttttgaaagcaaacaaaaaatggggaagccaggacagagctgttgtttctgaaattttctacaatatcatccgttggaaaaaacgccttgaatactatatgggtgaaggtgtaaaacccaacaatatctacaaactaatcattgcgtatttgctttggagcaaaaccaattataaaaaatttgaagaatttgacggaattaaaatcgccgatattcttaccaaacttaaaaagaacaccgttcctacaaaagcaatagaacattctattcccgactggctcgctgaaacacttgaaaaagaactgggtgccaactgggaaagagaaatgacggccttaaatgagcaggctcctactgttttaagagctaattctttaagaacaactactaaagaacttatttctgatctttcggatgaaggtgttgtatcttatcctgttaatggttatcctgatgctgttcagctggaagaaaagaagaatgttttccttaccacagctttcaaagaaggattatttgaagttcaggatgcttcttcccaaaagatcgggtatttccttgatgtaaaagagggacaaagagtggtggatgcatgtgccggtgcaggaggaaaaacacttcacctggccgcattaatgaaaaacaaaggacagatcatagcattagatatcttcgactggaagctcgcggagttgaagcgccgtgcaaagagagccggagcccacaatattgaaacccgtatgatctccgacaacaaagtgatcaagcgtcttcatgaaaaagcagacagacttctgattgatgctccatgttcaggtcttggagttttaaaaagaaacccggacagtaagtggaagattgatcaggattttattgacagaattaaaaaggagcagcaacaaatccttcaggattattctaaaatacttaaaaaaggaggaaaaatggtctacgcaacgtgttctatccttccttctgaaaataatctgcaggtagaagaattcatcaaaaacaatcctggattcaaaatgattaaagatgaaaaagtaatgcctagcgaagggtatgacggattctatatggctttgattgagagagtttcttaatctgatcctaacaacaatatattaaactactctattttatagagtagttttttatttcaaaatctttctgaaaaaaatgtaacaatttttgtaacatttaatatacattatctactaactgtatagattaaatccgttttttgacgctgtagaaagtttagaataactttgcaggaaactcatttatttatgcatacaagaattgttttcaattttctggctgtttttttatactgtctgttttctgcacagacctatgaaattcagtataccagctcttataacggaaaaatattaactgaccagccttctaccattgtatgggttaatgaaaaggaaaattttattctcaacaatacgatcaaggagcaaaaaagcaactatccttatgagatcactaaggtagaaaagccatccaatactattgtctcttatgcatttttaaaacccggatcaatcatctcaacatcagatgctgaatctgtaggaaaacaggattttgaactgaccaatgagacgaaaaaaattctgggatacaactgtaaaaaagcaatcacaaaagtcaattccaataccattgaagtatggtataccaatgatctgaaactaaaaggcggaccttctgttctaggacaaaatctgggattggttctggaagtggagagaaataaaaattctttggttacagccggatcaatcaaaaaaatcaagagcaccggagttgaaaatattctgaaaggaaatattcagacaacagatcagctgggatataaagatgagctttggaaaagcagatttaccacactgaatgtttttgaaaatgaactcatcaatttctctgaggcctcaaaatctgacagccagataaaaagatatgccaacggaaccattatccttaaaaaagtaaaattccctgctattacagaaggtgaaaatatttttatagagctgaaacagcagtctaacggagacgcctatgacagaacaggaactgttttttttattccgcaggacaaagaaaagtctttttttgatggactggaaaaaggagtgaaaacacttcctgtctacgaaaacggaaacggaaaacaatattatggagtaacggcttccgaaaactacagccctgccatggaaatgatgcggttctttacagcctttggcattcagaagttcaaccatatccagcttaagggaaaagactggcagactataagtccgtaccggcaggatattacagaattgaagcctgctctatcaggaaaagagctatggataggaacatttattggcaattatgataaaggcggacataaggtgagtcttgacattactatccataaaagcgatcagacagttcataagaacaatgtggctattccgctgttcaatactttaaatattatggaaatggccggacaggattattctacaatgttcaatcaggataaggggcttcttgtcaatttcactttagataaagatctgaaaaacgcacagctaagatataccaccaccgggcacggaggctgggaaaacggagacgaattcgtcccaaaaaccaattctgtctttgtggatggaaatccggtattttcatttattccctggagaacagattgcggttcgtaccgtttatataatccggcttcaggaaatttccaggacggactttcttcatcagacctcagcagatcaaactggtgtccgggaacagttaccaatcctaatttcatctctcttggagatctgaaagcaggtaagcatacgatacaggtaaaaattccgcagggaccaacagaaggaacaagcttcagctcatggaatgtttcgggaacattattggggatccaataaaaacaaaaccttcttgcatgagaattgcaagaaggtaaaaacacaaatgatgaaaaaaaattatttcgagccacaaagtaaggagtaaaattcatataattaattaccatagattaataaatatgtcatttttatttcgtatgagggtgacattaatttacctcaacgaaaaaaatcaatcaaacacctgctaatttcaaaaaatagttaatatttttaacttaaaaatattaattggttaaaattttacacatttaaactttttttattgttatttataaacatcacttctacttttgtcccataaataataaaaattatgtgtggaattgtatgtttatttgacgccaaacagaaaactgatgtattaagaccccaggttttggaaatgtcaaaaaaaatccgtcacagaggaccggattggagtggagtttttcagaacgaaaaagtagttttctctcatgaaaggcttgccatcgtagatcctacatccggaaaacaacctttatttaccaaagacggaaaagtagtattagctgtaaacggtgaaatctacaaccatagagaattaaaagaagagtttcctgattatgaatttcagacccagtctgactgtgaagtaatcctggctctttacaaaaaatacggaaaaaatttcgttgaaaaactgaacggaatttttgcatttgctttatatgatactgaaaacgacgtttacctgattgcccgtgaccatatgggaatctgtccactttatcagggctgggacaaaaacggaaactattatgtcgcttctgaactgaaagctcttgaaggagtttgtaaaaaaatcgaaactttcttacctgggcattttgtgtacagcaaagatggcgctgaacttcagcaatggtataaaagagactgggaaagttttgatcatgtaaaagaaaacgaaacggatattgcaaaattgagaaaaggccttgaagatgccgtacacagacaactgatgagtgatgtcccttatggagttcttctttccggaggtttggattcatctgtcatttcagccattacagcaaagtttgcacgccagagaattgaaagtggtgatacccaggaagcctggtacccaagacttcacagttttgccgtagggcttgtaggttctcccgatctggcagcggctcagaaagcagcagaacacatcggatctgttcaccatgaagttaactttactgtacaggaaggactggatgctgtacgtgacgtcatttatcaccttgaaacgtatgatgtaacaaccatcagagcatccaccccgatgtatcttctggcaagagtgatcaagtctatgggaattaaaatggttctttcaggagaaggttccgacgaacttttcggtggctatttatatttccacaaagcacctgatgcaagagaattccatgatgagacagtaagaaagcttggtaaacttcacctttacgattgcctgagggctaacaaagcattaatgagctggggaattgaaggaagagtccctttccttgataaagaattcatggatattgccatgacgattaacccaaaagataaaatgatcaacacggcagaaggaaaaattgaaaagtgggtattgagaaaagctttcgaagatattcttcctgattctatcgtctggagacagaaagaacagttctctgatggtgtgggatattcatggatcgatactttaaaagaggttgctgaaaaagaagtaacggatgaaatgatggcgaatgcaagattcagatttccgttgaatacccctcagaacaaagaagagtacagatacagaactatttttgaagaacatttcccaagtgaaactgctgcagcaaccgttccatccgttccatctgtggcatgctccactcctattgctttggaatgggatgaagccttcaaaaaaatgaatgatccaagcggaagagcggtgaaggtacatgaaacgtcgtattagattatgttatttgtttcgggatattttaacgcagagtacgctaagatatttccattagtgtttaagaacgatcgcaaaggcgtttcacttagcaacagacaaaccgatatccttgctgaacgaagtgcccttgcgaacgaaatatatgggattaaaatataaaccttgcgaccatagcgtttatttaaccttgccaataatattaattcactaattaaaatatatatttttcacattcaaacctataaccctctcaattataatttatcaatcctgtagtaatacaggattttttcttgaattaacaataacaatatggcataatttaactcacaatccaaaataatatctaataaataattatatttggaaaacgaaaatatcaattataaaaaaatgagaagaaaccttactgttttatttgccttattagccataagtttcgcttttggacaaggaaaatatggcaaatatctgaattcaaagaagcttgctttggcttacaagagtgtgaaagaccaggataaagatgactactatcaacaatattattggcttgtaaaggcagagcagctgaaaacgtatcctcaccttaaagatataaaacctgttgttttatacgaatttgtaaaatatgtcaatcctcagaatccgacaaaaaaactggatgccagaggaaaagaacttagagcaacagcagaattatctttgaatcagtattttaaaaataaaaaatttgaaaacaattctgttttaatgtacaaccttgagacgtatgtagatccttcaaaaggccagtattatactaaggttgatccggaaaaaatcaaggaactcgtacctaaggaattatttgctttcaattcttacaacagaaacatcggagaggaaaaaacatactatctttggattgacaagaaaaaggacgatctgaatattgtagacatcattcctaatgaaaaagaggacaaagctttttataccagattaagacaatatcttcccaattataaattttcaaagtatgttcctactgtaaaaaaagggaacaaatctgataaaacagatattgaatactattacatcatgccgtttgagcagaatacagataacatcgaatacaaaacaaaggatttcaaaactttcactttaagccagtacagaaaagccggtgatgaatggaaaggagtagaaaaacctagaaaataaatcaaaaagtcctgtgaaatttcacaggacttttttaattttatatgcatttctttatctaaggatcaaaccgcttaaagcaagtggttcttcaaatcaaataagtctgggagttttttataacccagccggtacaaaatgacagaagcaaatacaccacagacatccgtaaaaaaaatacttcccttaattctggccactgctatttttatgcaaatgctggattccacaatcctgaatacttccctacccgctattgcaaaagatctgaatgagtcaccactcaatatgcagaatgccattatcagctacgttctgaccctggcagtttttatgccggccagcggatttcttgcagaccggtttgggacaaaaaaagtgtttatattttctttgatattattcagtctgggttcgctcttttgttcattatcccaaaaccttactcatctcgttatttcaagagttatccagggagttggaggaagtttgatgactcctgtagggaaacttgcacttatcaaaacctttgataaaaatgaacttctcaaagcaatgaactttgcgatcattcctgcacttatcggacccgtacttggtcctttggttgggggctacatggtagattatctttcgtggcactggatatttcttattaatatcccgattggccttctgggaattcttttgggattaaaattcatgcctgactataaatctgatgatgtagattttgatttaaaaggcttcctgatttttgcagcagcctctctcctgctttctgtttcactggaactttttggagacatacagaatattacgcctgttttacttgtatttattatgggatttcttttcctgtattattattacaaacatgccaaaagaggaggaaatcctatcttccctttaaacctgtttcaggtaaggactttccgggtaggtattgtaggaaaccttgccaccagattaggaatcagctccgttccgttattgctgccattgatgattcagattgcctataaacagtctgcagtaacttcaggctggatcattgctcctatggctttaactgcgatcttcgggaaatcatatgtgattaaaattttagataaatatggataccgtcagactttaatgatcaatacgttcatcatcggaactctgatctgtctgcttgccattcccgatatccatacttctctgtactggtttgttccaatcatcgcgatattaggctttttcaactctatccagttcacttccatgaacactatttccattgcagatctccggaactttcagaccagcagcggaaactctttactctctgtcaatcaacagctggcaataggctttggaatagccttcgggctgattgttttaaagctgtatgaaaatacagacctcatcaagggagaaatccataatgcattccggttaacttttcttacagtagggatattaacgattttatcaggattcgtgttcaggagactacatatttcggacgggaagaatatgaagtcgaaggaagaataattgtaagggaaataataaaaggcaaaaaagcaaaatcgcaaaacggcgaaatactaatacataatgcagagcagttctgctcatttgcagttttgccatttttcggtttcgaagtttttcctcttcgcttttctcctttcacgaacttaacacagatcaatgcttttcacaggcaactatggtaattttgtttacataaatcaacaatgtgatggcaactaaaaaaatagaaatcgtagtatctccaaaacctgcgcattttgtaggcgatggattcagggttcataatttcattccgggagtacctggattggatatgaaaagaatggatccgttcattatgctggattacaattcaaagtttcactttaacggatcagacagaccaagaggtgttggtgtacatccacacagaggttttgaaaccgtaacaatagcatacagcggaaaagtagagcaccacgacagcgctggcggcggcggtgttatcggagaaggtgatgttcagtggatgactgccgctaaaggagttcttcataaagaatatcatgaaacagaatgggcaaaagaaggaggaattttccagatggttcagctttgggtgaatcttccggcgaaagacaaaatgagctgtccaaaatatcaggctattgaaaactctaagatggaaaaagttgatctaggtgacaatggttttgtagaggtgattgccggagaatatgacggtcacaaagggcccgccagtacattcacaccggttcacatgatgaatgccaaacttaaatcagggggaaaagctgattttaatttccctgcccatttcaatacagctgctttggttattgaaggaagtgttattattaatggcgaggaaacggttaaacaggaccattttatcctgttcaagaatgaaggggaaacatttaacattgaagcaaaagaagacgctgttgttctgatcatcagtggtgagcctatcaacgaaccgatttatcctcatggtccttttgttatgaattcgagggaggaaatcatgcaggctttcgaggatttcaataccggaaaattcggatatctggaagattaaaagaattaaatttatcgtaatctttaattattccttttttattaactttatatgatggcaaaccttacgggtttcagaaacctgtaaggtttagctattatcatgaatatgctctgtttattctatttggaaaacagaaccctttaatgcaaaaaattatgaaacctgaatttgaaaatatacctcttgtaaaagcagaaaaaagatttgaaatagaagtcaacgggtatcacgcatttattgattatcgtgagactatgcaccagatctctttaattcatactgaggcagatgctgaactggcaggaacaggtgcagccgcagccgtagtggaaaaaacactcaattatattgaagagagcgggaaaaaacttctaccgttctgtccttatgttttcgcctttatcagaaagcatcctgaatggaagcgtatcgtggatgagagatttgaaggatatgacaaactctaaacacttcatcaattcaattaaataacatttaaaaaaagtatcacatcattatgtcaaatatcggacttatcattgaagaaaaagcagcggatatcggtaatttcctcgtaggaagacttcttcctttccgtgaaaaaagagctgtcggaccttttgtttttattgatcatatgggaccgtcagaattaaaagattatcagaatcttgatgttccgccacatcctcatatcggtttatctacattaacttatctgctggaaggctctattttccacagagacagcatcggaagtgctattgaaataaaaccgggtgccgtaaactggatgactgccggaaaaggagtggtacattctgaaagaactcctgaatatttaaggcacagtgataaaagactccacggattccagatctgggtaggacttccaaagcaccttgagcaatcagaacctactttccatcatatcgaagcggatgatattccggtttgggaggaagacggcattcagtataaattaattgctggtgaagcattcggcagaacctctccggttcctgtacacagcaagttatttttccttgaaatcaaaaccaaagaagctaagaaaatcagcatcggaaaggatctttacggagaagcggcaatgtacgttctggatggaactgtgacaacagacggaaactcttatggttcaaaacagctgatgatcgctaaagacaccaagctttgtgagtttgatatgagtgaaaacggaacggtttatcttttcggtggcaagccctttgatgaagagcgttttatattctggaatttcgtcaactctgataaagaattaattgagcaggcaaaagtaaactggaatgaccagaatcacgaggcgtttcctctggttccgggtgacgaaaacgaatatgttccgcttcctaaggctattttaaacagaaagtaacttcagcccgatttattaccatgaaaatattagcatttgcaggaagtacgtcttccacgtctatcaacagggaactggtaaaatttgttctgaaagattttcaggatgaagaaatcaatctgattgacctcaacgatttcaccatgcctgttttctctgtagatcttgaaaagaagggctttcctgatcaggctcatcagtttttaaaagttattgaggaatgtgatgttatcatctgctctcttgcagagcacaaccgttcttacagtgctgcttttaaaaatgtttttgactgggcttcaaggatcaatgtaaaagtatttcagaacaaaccaatgcttctgatgagcacctctccaggaggctatggcggcggaaatgtgatgaatacagcaaaaacattttttccacagttcgcagcagatatcaaggatacattttcattacctaaattttatgaaaattttgatatggaaagcggagtgatcaatccggatatgctgaatgatctgaaaggtaaaatacagaattttaaaaatcaggtaaaaacaaatgactaagggaagactggaggctttcagtgatggtgttctggctattattatcaccattatggtacttgaactgaaagtgccggaaggaaatagctggaccagtctcaaacctcttcttcctaagtttctggcttatatcttcagttttatttatgtaggaatctactggaacaaccaccaccatttgtttcagaccgtaaaaaaagtaaatggcagcattctttgggccaatcttcatctgttattctggctctccctgatgcctgttgctacagaatggatcggcactacaggttttgcaaaaaatcctgtggctgtctatggtatcgggcttatcatgtcagcgattgcttataccgttctggagcatgtgatcatccgctgtgaaggggaagattcaaaactgaaagaggctattcattcaaaatataaagaatatatctctattgtattttacgtcctgggaatcgctacttcatttttttatccttatattgccataggtttttattatatcgtggctctcatatggctgattccggacagaagaatcgaaaaaacattaaaagaaaattaatatggaaacacacgaatatcccaacggcgacatcactgtcatctggcagccccaaaagtgtatccactcggctgtatgcgtaaaattacttccgaaagtctacaatcccaaagaaagaccctggataaaagcggaaaacgcaagcccggaagaacttagaaaacagatagaccaatgcccctccggtgcattaagttataaattcaacacagaaaaataatggcggtaacagtaaaagcaagtttaggaaaaacaaaatattatacagaagtaacagccggcgaaaatcagatcattactgatgagccgattgataaaggcggacagaataagggcttcaatcctctggaaattctggcaacgtcactggcaagctgtacagctgctacattgagaatgtatattgaaagaaaggaatgggatgtggaaaacatcaatgtggaagtagagcttgaaaatttcccgttaacaaaaagagctgtcttcaaaagagatatcagctttgaaggtattctggacgacgaacagagaaaaagactgcataccattgccgatgcatgccctgttcataaaatcttaaccaacgacatagaaatattaaccaaattctcatagtatgatcgaagtaaaacaaaacaacgacgaaaaacacggaagttttgaagctttcatagatggaagacgcgcaggaatgatgacgtatacctgggcgggagaagaaagatttattattgaccacaccgaggtggaagaagcctacaacggaaaaggtgtaggtaaggaaatgcttctggcagcagtagatttcgccagaaaaaacgggaaaaagattatcccgctctgccctttcgctaaggcaagtttccagaaaagtgatgaacttcaggatgttttagtgaattaacactgtttccacccttacaatacaaaccttccggaatagatccggaaggtttttttatgcacttatttttatttttaataccagtttctcatgtaaaaattgtgtctgaactaaattcacgattcacgactgatcttttttatatatttgctaaaatttaaaaatcaggcatgaatccaggaactatccttttgctatttgttttcgtctattttatcggtcttttggtgatttcctatttcaccagccggaattctgataatcagtcattttttatcggtaataaaaagagtaaatggtggctcgtagcattcggaatgattggaaccagcttaagcggggttacttttatttcagttccgggaaccgtcggaaaaatgaccgggtccgaatatatttacggaggttttgagtactatatgatggttatcgggtttttcatcggatattttattgttgcagccatattacttccgctgtattataaaatgaatctgacttccatttatacttatcttggaaaaaggttcaatgtggaagctcataagataggctcaatcttttttatcatttcaagagcaattggtgctacggcaaggctatatcttgtggtaaatgttttacagattttcctgcttgaaggattgggagttccgttttgggtaacctcacttgtgcttttgctgatggttcttctgtatacttttgaaggtggcgtaaaaacaattgtgattactgatacgctgcagacctcttttatgatcatcagtcttgtggcatgtatcacttatattttatcaaacctgaacttatcttttggggaagcttacacgattctggagcagaaaaactatactcatttcatcaattttgatcctaattccaaaacctttttcctgaaaaccattctgggaggaatttttattacgattgccatgacagggcttgatcaggaaatgatgcagaaaaatatctctgtggataatcttaagaactccaagaaaaacatgcttacgtttgcaggaacgcttcttctggtaaaccttgccttcttatttctgggaggactattatacctttttgcactgcagcatggagcagaatatggaacgataaacggtgaaacagtaacgaatattttcggatttaaggatactgcaggaaacatcaaaaacattatgggagatgatcttttcccggcgctgtcacttcagggatatttcccgatggctatttccgttatttttattatcggattgatttccgcattattcccttcagctgacggagctttgacagctgtaacgagttcgtattgtgtagatctattaaaccttaacgaagataaaaccaaaaccgaaaaagaaaagaaacgtcttcgtatgaaagtgcatttaactttcactgttgttttcttcattcttattatggtttttaaagcaatgaatgacaagtctattgtttatcttatcatggagattgcagggtatacttacggaccgcttttaggacttttcgctttcggaattttcaccaaatttcagatttcaagaaaatactctattcttaccgtaacgatcttagctcctgtacttacttatctgatcaatctggcggttaccacttatacagattacagaatcggcgtagagctgattgttctgaatggcttattaacttttattggcctatggctggtaaaagacagacaacatttaagagtagcttaattaaaataaaaaaataaagcggctgttttcaattgaaaacagccgcttttatatcataacccggatggattattctttaatccacttgattgttttatctatattcttagatttaactttaatcaggtaatctcctttaaccaggtaagacaagtcgaaagtacctgttttatcatgattcagtttattatttgccttagcgaataccagtttcccgcttacatcatagattgtaatatcatatacttcatttgaattggcaaactgaacattcagcaatcctttgcttggattaggatatactacaaatacttctttatttgcagatgcttcattcactcccaatgtctgggtgatggtaaagttaatcgggctaatattatagaagacgttcgtttctgcagctaccataattctggcctgcgttgtattcacgttaggaatggtaactgtctcggaaccatcgttcggagtagaacctaaaagcagtgtaggataagtaagacctccgtctgttgaaaggtaaatatttacagtagcggcatttaccgggaatgcagttgtattagcaacattccatgttatggtttgggtagaattccctgcccagtttactgctgtagtaggtgctgttacagtaaacggccctgagttaccatctacagtaataatagcatcatcgtttgaaacccctgcgcaacctgcattgttatctcttacagtcagtctgaattccattgttcttgcgtaagaaggtctaacttctcctttggaaacagtaccattaatcacatctgtaagttttggaaaatatctgtaaggaactgttaccggaaggtatgatctgaacagcggtgcatttcctgttggagcattccagtcacctgcaggtcctacatcattctgttcccagctgtaagtaagcggattgttatcgatatcagaagcagatccttccagtctgaacggtgtacctttaggaattgtataatcaccgccagcatttacagtaggagcgaaattattggaaggaatagtcacctgacatgttgttgactgaacttttgccgtgatagactggaatgattttgtatggaaagtaggaatactgttagccgctaagttatttgtacttccacaaattcctgcataagccataatggtaatcccgcttcccggctctacagcattggctgcactacggtttccaccaccacagcttcctgtagttgcattaaaagtatgtggccctccaaactgatgccctacttcatgagctacataatcaatatcataaggatcgcctactggatttggcgaaccggtaattccccttcctttattggtactgttacagattacgcctaatcccgctaatcctccgcctccggtactgaacgtgtgtccgatatcataattggcatttcctatcagcaaatcaatctgagtctggctttcattaatcagtgtaccggcatcattatttccgttaaatggatctgaagtcgcatttgtaaagactacattggcttcatttgctaccaataccaatcttgaagctacttcctgctcatagactccatttactctgtttacagaagttacaatcgctgaaagtgtctgtgcaacagtaggagtagcagaaccggttgctgccacagcatattcacctgtacaggcaacagcaagtctgaaaactctaatttgagttcctacgcttggacttacggttttctgagcgtttttttttcctaacggagaatcgtcttcatcttttactccgcaggttcttggatttttatcaattaaatcactttttctgtaaataatataattgttaatatcctgttttgcataaggatcaatataagtatcccctgctactacagattttatctgtgcatggaatcctaattcggtaaaatccagttttatcgtagcatacttatcgtcaattccctgccctgtaaaagtaacaatctgaggaaactgaccggccaattccggagccatcactgaagatttccagattctgaattttgcttttgtgccatcaggcattggcagtacaataactggtgcggtatctttacgatcactgtctcttaattccggaacagtattaaaataatttttcattccggccacatccaatgtataggtcagtgacttttccggttgtacggttctgtttttaggatctgctttaatagacctttcactgattaccgtaaaaaaatcctgggctttccctgaggaaacggatataatgaatatccccaaataaaataattgtttaattttcatatataatggtatgtaatttttattcattttgaacatcaatcaaagaccaaaaaattttcagtcaaagaaaaataaatcaaaaattcttgaattataaaattaattaaattaatctgattgtcacataataaaattcaaaaaaaatgaatataaatttaaaaaaacaacaagaaaccttatgtttaaagcattaaagcaaaagagaatagtttattttttttctttttaataaatcgttactcaacgtatttcaatatctttgaagtggataaaataaacaagacaataaactcattaaaataaaaaaaaacagaaattaaaaaaccatgaaaaaaattattacaattttcacatttctattaacacttagctttatgaatgctcaggagaattttgaagtatcaacattaagaatcggaccctttaaggtcttcatgccaaaggttgaagctgagaaaatcgcaggaataaaactgggcaattctaacggagagaaaaaaaacatagtaaaatataatggagaggttattcagattgatctttttgataattatatcaatgaagctaatcctagtgttccttctatcacgtatatgacgacaacaagtaaaaaatttaaaaccaaaagcgggatcggagtcggaagcacaagggatgacctcattaacgcttatagaaattaccctaatttcagtgtgcgtccggattgggataaaaacgataagccggttaaggattcgggttatttcaatattgaggacagccaggcaggaaccctattaagctttaaatttgttaataatattgttactgaaatttccgtctacctcaatgaaggctgttaaaagcggagtattaaataaatcatacaaatccgggtttttatatcccgagaccggcatttccggtaaaaaattgtaaattcgcatacaaataaatcagatataatgagtaaaagtattgaagagttaaaaactcttactacgcagatcagaagagacattttaagaatggttcacgctgtaaattcaggacacccgggtggtagcttaggctgtacagagttcttcacagccctttacggaaaggtaatgaactataagcttcctttcacaatggaaggcaaaaatgaagatcatttttatctatcaaacggacatatttccccggtattctactctactctggcaagattcggtttcttcccggttgaagaactgagtactttcagaaaattagattcaagattacaggggcaccctactacacatgaaggacttccgggagttagaattgcttcaggttcacttggacagggactttctgtagcacttggagtagcacagggtaaaaaattagatggtgatcagtctcttgtttactctcttcacggagatggtgagcttcaggaaggtcagatctgggaggcattgatgtatgctgctgctaaaaaagtcgataatatcatttctactattgattataacggacgtcagattgacggagatacagatgatgtattaagtctgggaaatcttcatgcaaaactggaagcattcggctggattgttctggaagaaaagaacggtaatgatcttgaagcggtcattgcaattcttgagaaagcaaaaacagaaaccggaaaaggaaagcctgtagctattcttcttcatacagaaatgggttatggagtagattatatgatgggatctcatgcatggcatggtaaagctcctaatgatgagcagttagacacagcattcaagcaattgtacctggaagctccggctgattattaattataaatgataaattattattgataaatgattttataatatgtttaatctctcatcatttatcaatgatcaaaaactttagtaaaaatgaaatatacatacacagaaaaaaaggacactcgttcaggattcggagcaggattagcagaactcgctgacaaaaatcctaatgtagtagcactttgtgcagaccttatcggttctttgaaaatggagaaattcattgagaaagctccggaaagattctttcagatagggattgctgaagctaacatgatgggaattgctgcaggtcttagcattacaggaaagattcctttcacaggaacttttgccaacttctctacttcaagggtatatgaccagatccgtcagtcaattgcttactctgacaaaaacgtaaaaatctgtgcatctcacgcaggtcttaccttaggagaagacggggctacgcaccaggttcttgaagatatcggtatgatgaaaatgcttccgggaatgactgtaatcaacacttgtgattacaaccagactaaagcagctacattggcgattgcagatttcgaaggtcctgtatatttaagattcggaagaccggtagttcctgtattcatccctgaagatatgcctttcgaaatcggaaaaggaattatgcttcaggaaggtactgatgtaaccatcgttgcaaccggacaccttgtatgggaatctcttgtagcagctgatgagcttgagaaagaaggtatttcatgtgaggtgatcaacattcatacaattaagccccttgatgaagagatcattttaaaatctgtagaaaaaacaggtaaaattgtgacggctgaagagcacaacttccttggtggtttaggagaatccgttgcaggtatgcttgcaagaagaaggcctacaagacaggagtttgtagcggtgaatgatactttcggagagtctgcaacccctgctgaactgatgaagaagtataaaattgattctgaagctgtgaaagaagctgtaaaaagaattttagctaactaagattagtatttataatataagctccggctggttcagagaaccagccggagcttttgtttaggttataaaattttgattgtttttctattaatgaccaccgtcaaaaattctctgaatttcactccctcaccgagggatgagaatggtcatacttccatttttcatagtattagtttttatcctctttatttattactccggcggattcggaggaattcctacagcaatcagaacaggtcctaaaatttctttgatatattcatcttctctcctttcagaagcttttgatcctgaaaaataattgctgatcctgtagtttttcacaaactgatttcttttttttccaatggaataataatagccacctctttcatcattcacgaaataggccatttcatcaaaattcatgagcttcctggatagtaataattttctgtaaatgcacctctctgatttatcaaagatatattttaccggaattctgaaaaagagatcaaacagaaagtaaatcatataaatagcccacaatcctattgtaattttaaactggtcaccagatatcttatctatgaaaaagccgataatcaagggaagagcgatcactcctaatgccagccaccatatcaaagcacgcagaaaaccataattgggcataaagcttatttcacttccgttttcctcaaatttatagcggtctctgatatccattctcaggattattaaggtttaaaatatcttctgtctcgttaaccattttctgtattcctttttcggtaagagcctgtccaatcgtaagctgcttttctcttccatcaacttcaaagtacattgacagcattacatttgtggtgataaaacctagatatttggtggccaaaacatgaaaatttctgaaattttctataggataagtttttaccggaacaaaaatggagtgttttccggtaatcgttttccggtccaaatcaatgataaatttcttggtaaaaaaattgattaaaataagtactaccacagcaataataatgtagcttcctattcttacactattaaaaatcaatgctgcgatgatgagaaaaaaaatacaaagcacggatacaaataccggttgatttttaaaaatatactggtttccttcttgtctgtaaaatttataattattcataattactgttattgttctttttatattttggtttgtgattacgtagtgaaagatcatttagagacttctgaggcaattattttatcgggcttcatatttatatatttaagtgtttttttaattcgtcatacttttaattgccgcagacagtcatccagttcagacattcacttttgtatttttgatcatttagtttagtgcatcctctatttgctgtttcaaaatttcaaaacccatacttctctccttttaaaacggatggtaaaattacttttatcctgtcaaatcaacacattctattctctataggtacagccagtttcatgattatagctatctgtttttatcatacataaccatccggaatcaaaataactgcaacaattagcataggaatcagctctcaatagtcagaactctgctatacttagggtaattcctaatgttttttaattccgggtttaaatttctggtgaattaatctacaaaagtgttataacggtcaagaacataccctgcttctctttccagattatcaagatcacggttcaggtcctgattgttttcattcaggcttcgctgtacgattctcattttacccaggaagtcattgactgaattgttgaatgcctgataactgttttccttctgtttttctgaagacggaattttttcgttaatatttttgtcatataatttttccatctgctgatattgctggaaaaatttatttttatagacatttatatccgttacatcataggaatcatcaataattttctgagtcagctccataatctccctggattgtataatctgcgttttaagcggatgatctttaagcacctctacttctgctttatctgctcttggggaaagcttgctaaataaatcattggccactgtacggttttctttgataagttttattgccttttcgttgatttcagcaactttctttcctttatcatctttccagtcttctgcctgtttgtaattgtccagttcctttttcaaagattccagctgggtcattgtacccttcatcttatccacaagattctgaaaatcatttcccaatacatccggagcctttaattcctgacgggtgtacaacatcactgaaggggtaaaaatgggcataataccggaaaactgcgggtttgcatcaacattttttacataatcttccatctgtttcaatacattctgaaaatctttgataaaatctgactgctcgtcatccattttcacgactttgttattaaaagaaataatatctctgtttgcatccccggaattaacaccgaaaggatttacctttccgctatcattctgcgacagcttttctttaactttatccagtttatcacatgatataacagaaaagcttaaaaaaaagcattcctgcaatgattaatggtcttttcataattctaattaaatattaggtttttgccaaattttttgaatcctatccgataaaagaaaacttatcttcaaatatttttccgataaatggcaaaggtttttcaacattattggcagcattgataatcccgataatcatcagtattaaaggaatgaaacccaatattcccaaaactccaattttggtaaccatcagtatgatattaagaatgatggataatacaatagaaaaaagtatcagtcccaaagactgtttcaggtgatattttaaaagactgtcagatttttcccttccgacaacgaaagaaattagccatccgaaaagggtgatgtaagatacaattgataatgttttgttgtccataaccataaaattttaaattaatattctttgatttttctaagccaaaattgcgacagaaaaagttgctgacgttcttttaagcaactacaaaacatcttcaatgcagcttacggatgactacaaaacgtctacaagaataaataaaatactgatttacagaaatttaaaaacaatccgtatttcttctttttaatacaggaaattgacaggtgtctgcaatttttgtactttcaccctatgaaattaaggtactcacttttatactgtatactttttatctgcactttatatcctgcacagaatacatttattgatggtcttaaaagccaattgaatgaagatcatatttctgttgcagaaaaattcagaatttataatgagcttaccgaatattacagagtcagtgatcaatattccatagctgaaaaatatgttcagcaacagctggaacttgctcaaaaggaaaagaattatgctgaagaggtaaaagctcttagtcaaaaaggagtcattaaacttaatcagtctgaatatgacaaggttccatctattatagatgcggcgaatgcaattgttcaaaagagtaataataaaactgcggaattatatgccaattatctgaatatctattacagaaacgcgcttggtgaacttgaaaatacaattaagctggttcagaaagttcttcccgttgttgaaaaacaatcttctgaaatcttattaaatgcaaaactgaattatcttctttatggaatttatacagaatggaacgatgcggagaacgccaccaaatatgcaaaaaaatccatagagcttgccgaaaaagcgggaaacaaaaatctacttagttctacctattcggcgctggctgtctgttattctttccaatatgaaaaaagcggaaaattacaagatctgaaaccagtcatagagatgtgtaaaaaagctgttgccttgtaccatcaatttcctggtcatgtctcagcccatgtacatgcaatggcattactaaaccttaccaactattatctgagctatcctgttatgactccggaaatccgtacagaaattcaaaataatgccaacgaaattctgaagcttacacagcatacaactcttaaccaggggatgcaggctggtgcgcttggtatcttaagcaatctggcatcacgggatcagaatgatgctttatcagaacaatatcttttaaaagcagagcagattcttcttacgcaacagccggtttattaccatgtcatgatcaatgtggtaaaaaaccttgctgagctgtatgccagacagaaaaactacaggaaagcatatgagtacgaaacaaaagttacggaatacagcaatcttctctttgacgaaggacaggcagaaacggcaaaaagattggaagctcaataccagtctcagaaaaaagaatctgagctcaagtcccttactgaaaaaactgccagcctgaaaaaagagaagctgttatacatcggtttgggaatcattggattgattggtgctttctttatgttccgttcttaccattttaaactccggtattctatagaaagagaaaataagcttgatacggaaaaacacgaagcagaaatggagattaaactccagcaagaggaacaggcaagattaaaagccgaacaggcgctccttactcttcaacagcaaaagcttcaaagtgaggtactggccagccaattgcatattcagcataagaatgaggttctgcagcaacttcagactcagctttccgatactgatattaatattcatcaggtggtaaaaggagaaaaccgagttgataatgattttgaaaagatcagatttaccatccaggaactgcatccggatttctttaaaaatgtcaatgaaaaagctaagcaaaaacttactgctctggatttgaaatactgtgcttacatttatcttgggatggatactaaacagattgccaatttacttaatgtggaacctaaaagtgtcagaatgaccaaataccgactaaagaaaaagttcggattagatgagaatattgctttagaatccttttttcagagagtatttctcggataatcaacattttatttaaacaacaacagccttttaacataaaattaaaaggcttatttttttccaatttaatatcattttttctactcaaacatataaaactgatattttttgtcaagatttctatgatgttattctcagtttttagattaaaaaccattattttttttgcaaataatatgcaaatttgcttggaaacgaatataaaaacatctgattttcgcctcttaattgtatttatttgtcatattgtacaatagaatatattactatacaagcctctgttaattttgaggttttctcaatattaactgcatcactttatacttttcaatgtttgaaatatttcaccaaacgtgctgaaatatacacaatttgcatatgcatgtgtgtacaaaaaataaacaaatcacttacaagttttatcccactgaagtgaactgaatatttatagatttgaaaacatcaacgttgacggaatgcatttccatttttagattgtatgtgtacagtacatgataaacatgagaaaccattcacccaaatgtcagggtttatatgacacaaatgtttacacaacacaaaaaacgtatcaaaatgaaaaaattaaatggaatgaagggtagcttctcttctgcagaaaacaaaaagttacaaagaaaagacttaaaatcaattttaggtggtgatgattataaatatgtagaaacagattgtggttctagctgctatgataaagagacatggaaggacggagttcgcatcagtactctacaaatagatacaagtcttgattaattctaatacagatagagggttatccctctatcttttttatcagatatattcatagagaattcatgggaaaagatacctggcattatccttcttacgcttttatagctataatttttactcttgcagcttgtaagagcagaaattataactatataatctattataataaaatcaatgaggccgacagtatacttcgttttcaaaaggatacaatggctgctgttaaacaatataaaaagatattcagacaatatcctcccaaagaccaggaacggatcaatgaatatgaaaattacataagactttcagatcaacatcataaaaattttggtgggaagaaaagtctttacaagcttattccgttagttgcacataattggaaatataaaaagcaagactccagcttcatacagctctatcaaaaatatggcattggcaggcaggaaatagaatttaaagttgaggaatggaaaagaggacttaatcaaaaacttgtagattcttttacagtcgcgtttaaacgtgatcaagacagccgtattgattcaaattatgcagatatcaataaaaatgataaaaagaatgctgaacttctgaggtggatgtttgagaattatggtttcccaagtctgcaaaaaattggtttatcaaatggtgatttctttatgccatcaggacctatattactacacatggcagattatgaagagtattacccatatttgaaaataaagctattagagtatgtaaaatctggtgaatgtcctccaagagattatgcagcgatggtagacagaaataatctgcaccataaagttccttatacctatggcgtttatcaaggatatgaaaatataaaagattctgcaaccgtcaaccgtaatcgtaaaagcatagggctaccgagcctaaagcatgctcaattgattactaaagatttcttcaaaaaaataaaaaagaaaaattgatacttattatttctcaaaataacgaaatcaccactacagaagttattaaatggcttctgaaagtaggaaaaagctttatccgggttcatgaagatgaaatttttgatattaagatcaaagaaaaacggatttatatacaaagcccgagaaattgtttttttattgatgaaattaccagtgtatggtatagaagaggagaattgaaatttaaccgtctgctctataagaattctgcaattaaccttaatatgaatgaatatcagcactggctggaagattatgtaataaaggttttagagtcgaaaaaacatatcaataagcaaagtaacagtgatattaataaacttcttgtacttgaagaagcacaaaaatcgggattagatgttccttattattttctggctgataatacagagaatgttattttaaataagacaattattaaaactattggcggaaatccaagaatggaaagcatactcaaaaactccagtggtatgatgtatacaacaactattcaggaaaaagaagatgaatttttttttattactttcttccaggaaaaaatcgaaaaagatttcgaaataagaagtttttatctgaataaaaagatttggtccatagctattttttcacaaaatgacgatcaaactaaagttgatttcaggaaatacaatactaaaaagccaaatagaaaagtaccttacaaccttccgaaagaaattgaacaaaaaattcatctgttaatgcagtctttagacctcaattgcggttcacttgatttcattaaaagtggcagtacatattatttcctggaagtcaaccccgtaggtcagtttctgggaatgtcagtcatttgtaattatttattagaaaaagaaatagcagaatatttatgaaaagagattttactaaaaaagaaaagaataaacttccactaacctttaaatatattgatgttgtaagcagtaaaagtcgtgagaagagatatttcagcataacaatctcctgtgaaaaatatcatactgatttctatgcaaaacttaatccttataaatttctgacgagattggtatagaatattttaacaagatgctcaaagaatgttattggttttgatatatggcaagtggtattcagatgatcagaaaaagaacttaatcttcaagtatttattaacttatgaactatttcaacctattcagcaatatcctaatcacgaaaggtcctacaagaattctgatctcggatctgcagagaaatatatcagaactgtatcctctggaattgtatgaaattattgtagagcttaaaagctattctattgaaactatactgaaaaattatgatcaggaatccagatcaattgttcacgaatatattgatcttctgctggaaaaagaatacggatttattactgaaaatgactgggacaggaatttccctcccctttctttcgaacatcatgaacccagcaccataaccaatcttttcatagaaatggcagacacagggatcctgaaaaaaatatatacatcagtagaaaatctgggaatcaaacatctggtgatttatagtttaaaccctttaacctcaaaagattttatagaaattgatacaatatttaaaaactcagtcttatcaggaatagaagttttttcgccgtttcatcaaaaaatcaacctatcttttgtacaggctcttcaaaaaaagacagtcagattatacagtcttatcttctacaattgttcgaaacctcctttcaaagctaaaaatgaatacaaattttcgctgcattttctgaaagatgatctgaaaatatctgcctgtggaaaagtggaactaaagtacttcaacaccaatactcctaaagtcattgaagcaattaatcacaattcctgcctatataaaaagatgggcattgacaaaaacggcaatctcaaaaactgtcctcttatgaatgaaagttttggaaacatcaatagtcaaaaccttgaagaaacagtaaaccaaccaggtttcaaaaaatactggaacttgacgaaagattatatagaaacctgtaaagactgtgagtttcgctatgtctgtacagactgcagggcgtataccgaaaatgctgaaaaaaacaaagaaggcctgaatatatccaaacctttgaaatgcggctataatccttatacaggagtatggaaagactggtcaaaaaatcctttgaaacaagaaatttttcattctctggaactcagataatatgttctcttttttattattcaaaaaccgcttttaaatgttatttaaaagcggtttgttatcttattgcaattgactaagcttatttaaaaaacttccatttcgggataatggcaagcattccgaatcctgtgaacagaaaaagattggtaacatccgtatacaggaatgtagacagataataattgtgcataaagaaatgcagcaccagtaatgccggaaacataaagatcccaacctttctgtaaaagaacatcagcaccagcccgatcatcatcagtacatcaatagaaaagatgacatagaagtaccaccttggaatctgaaggtattcatgctgcagatactcatccacatctatcccaagccccattacggtaaacaacatcaatgcggcaaatgcgagtataaatccccaccctttcttcgggtcttcatcaaaatagctgtattcttccatacctgcaaaaataaagaacttatgagagatttcataagttcttttataattattcgtttaaaatttgacttacacagagattgcgttgatcagtctgtttttgtcacttaagaattcctccatagagatcatactttcagttctcattacatcctgaatgtcatcgatctggtaaataattcttttagcatcatcagtgttcttagctcttactttacagaaaatattatattttccggaaataacgctagcctcgattacgttaggaatagttgacaattctttcaatacttcctgagtacggtttgattttgtcaaaaggatacctatgaaagctgtaaagtgataatccagcttaccataatcgatgttaagagatgatcccaaaataatacctgcatcttccatctttttcactcttacgtgaattgttccagcagaaacatccatctgctttgcaatttcagtaaaaggcattcttgtgttttctactaagaaatcaagaatcttcttgtctatttcgtccagttgatagttcatattagttaaattacaatttctttaaaaaatctatgtattttttgcaaatttacgaaaaataatttaactaaaaaatatatatcaaatattaacaataattaacacagatgataaaaatcattaaaatattctaattatttaccttgcgattttatagaatctgtttttatttcaccttttgcctctgaagtttttttgtcttttttcttctttttaaacaaagaattgaagcttttactccacacaacccctcctccataggcctgattagcagaaccgtttgtactcaccattcctatgtttgtaggcttggaataagcacgtatcaccagtgagccatcattctttttagacaaatcatattctactgatccttctgtggaaaggtaattgttttgtgcaccatcggttttggataacggaatacccaaccctgttttaatattaactcttggagaaacggctacacttaccccggcattggctctgtccccaaaatttgaattctggtctcctttcacataattaaggtcaatctggaattcgttactcatcgtattaagtacagatcccagctgtttcaggagcatattatatcctgaagattctgccacgtttcctacattcacatcgaatccacctgtattggatacgttaaaggtactcaacagcaatacagatccgaactgaagaactttctctccttcctggctcattttcgcggcaagggtttctcttacctggctggatacatccatagcagtcacattaaggtcaatctgcggatctaccaatgattgggtaatgtgcgcctgaagcaatatactgataggctgtagtttccccaggctcagatattcgccggcattggaaaccattctgatgtaattggcattaatatccaatgtaggcttcatcgcatcaccatcccatctgatgctgctgtttctttcgatctggaatgtcttattaaggatagccttggaaacgaatgtaccgttatctactttataggtaccgctcatggcaatatttccctgtctgttcatgtggaacctcagcggatctgcagatccttttacggtaatatttcctacatcgtcaccaaccagtacatttacagtggttcccttatctacagccagattaaaatcaatattcatattggctcctgttttcttcttttcttccagggtaatcaggccgtcttttccttctttcaggaacctcagcattttgaattcttctacattggaagtagaactggaattaaaggtaaaggtacttccgttaagtgccttcatattaggagtggttatactcaatcctgaaacagggccgtcaacatacaggtctccctgcccgtaaactcttccccagaacaagtcaaaatctttttgtgtcgtattcagcatcaacagattgtctgccctcattacgagtgacacccccatggaagaaagggtttcaaactgaatcgcccccgaaacatttcctttggaattggttcttccatcgtgcacttcaatattgttgagaatagcaagtcctctggacagctggattaccgtatcatcaaatgaataatctactcctgtaaacaaaagttttaaaccaaaatcttttaaagcaatatcaccgctataatcaagatcgttaagttttccattgattttaagatcccctgtagcttttccacgaaggtttccaaaaacggtctgtacaaactgctgcgtaaatgaaagatcaaaatcacgcatttctgcattaagatcaatgatcggagaagatgtattattattaacagttcctgtcagattaagactgttatttccaaggactcctgcagagtgaacttttacatcaatatcataaacattcaatgagaagccattggttgcagaaatagagatatcacccatatcattgccattcatcttaatattatcgatattaagatctaccagcggctgaagggtacttttatccattttgatcttcacacttccgttagcaagaccttttatatccatcgtatttcctcctgactgcatttccagcagtttttctacagcaaaatcattgatatcagcatctacataaaaatctttagctgatttaaactgtgcttctttaataaacaaagcacttttatcggaatataccctcaggtttctgatatcaaaatcaccggttttccttctgtaagtaatagaatgattcagttcgggacttgtatctattgcccatgtaacttcattgaattttacttcagtaggttcaaacctgaatacataatcacccgctgcatctgtagactgatccacattaatggcatattctttaagcttttcattcagttcatcatccggacttccatgtttgaacacggttgctaaatgaagtgtatttccgttttcattattccctttaagttcaaaatccttgatcacatttttattatagactactctattgatcttagcatacaattgctgattaaggtctgccgtgttaattctcactttaacactatccaccagggcactgtctctgctgatatttttcctgtcattgactttataatcaggattggaagctgccagcgccttatcagcatctgtaatttcttcctcttttgtcatgatatactttaaagaagccgcatcaagattcaagatcagattattggaatttccatcatattctccttctacaaccgctccctgaggcaacctgagatccggcaagaaataattgactaaaccttgctggacatcaaacttaagggcgaaattctgtccacgatataatttccttggcggtggaccaaccaatatttttcctaatccgttttctaccattccggcaagatctgccaggctgtatctccctgaaattttacctgtggcagctcccggagcatctacatctattacgcgggatcctgcttctataaatgtttttaacttagcattcggaatattatatttttgagtagcagtagcaaagtgaagattattggcattcacatccaaagtaaggtcattaatggaagacatagccattttcccttcaacctgtccacttaccacctgagtaccaggtttattggtaaaataattcatattcagataagtgacatcagcattaacatccattgctactcttgaagtactgaagtctatcaatcctttgaccgtagcttttgcctgttcatcattaacggttataagtccgttatattttttatgatccaacagcccgtccagataaaggttgttgatcgttttatccataatttcaacacttgcaatctgagatttcgtagtcagacgcatggtattgacatcaaagctttgtccgttaagatcaaatttaccggaaatcaaccccactgttttattcttggtgatcacagaggtgttaagatcttttacatcaagatagcctgaatattttggcatagctgtgctgtaacctgtcagagtaagcttggagatttttgcctgcccaattcctgtcatcagatttccgttatccacataaatctggtccgggttcacttttgctgttccgttgtactttagcttcccgaaatcatcagcaaaattcttcatctttttggagataaatgaaggcatcattgctttcagatctttgtaggtaaaatctgtggaaagatctttcgtttcgatagcaaaatgtcctttcagcagattgtcaaccttcattgttttcgtggcaatattcacatcagggtttctgatcaggaagttttccagatgaaacttgttcagcggaccagtcattgttcccgaaagattgaatggtttgatattatcccagtttgttacaaaatagctgatatcataaccgcttaactggcttccctgcttgatattcatatcccatcgtaccttatcggcaaaatctgcccatgagccgtcatgaagattgaatttgatatctccctgaagcaaggtatgatctgtattcagcgtaaggtctttcagtgatagaaactgcttcgttaacgaaagttctgttgaaaacgtatctacaagatgggcttttccccatcttgaagttacaaacgacatattattgatcagcgccgaaacgttcgggccattgacttttacattgggagcttttaagttgaattgtgttgctgtaagccattttccctgttcgccgggagaattttgattgacaatggaaactttggagtccataatctgtattctggaattcagctgaaaaggaggttttttcggatctcttttctttccgttgtcaaaaagttctacaaaccttacaaaattagaaatactgtctcctttataggtaattacttttatatcggcattgacaagtgtcagagaattgaaacttaaagaattactgtttccggaaatggcatttacggcaagagacatccagtctgagtctgcccgaaattcacgggctgtaataaaattaaagcctttataatcttttacttttaagccttttatggttacgtctccgaaataatttacatctacactttctgtagtaaaatcagatttgaaatcattattaacaagcttcagtgcctgatcagctgcccattgctttgtcaccggaagattaatggcaataagtactcctccaacaagcacaattccaagccaaaagagaatcaggagaagttttgcccaccaggtatagctggtaacatctttcacagcctgcttcccaaactcttcagctgtttccacaggatgatgtatggcatctgaagccagttcagatgcttctttcactgtctcccgaactttttcctctacattttcgacagttttctgtacctgattacctaggttttcagctactgattttttattctcattctcgttattattctctaactttgccattattatgagcgactctataattttaggtattgaatcgtcctgcgacgacacctcagcagctatcatcaagggaaattctattctttcaaacattgccgcgaaccaggccatccacaaagaatatggtggtgttgtgcctgaattggcttcacgggcccatcagcaaaatattatccccgttgttgaaaaatctttttccaaagcaaatatacaacaaaatgctatctcagctataggatttacacgcggacccggacttttaggatctcttcttgtaggaacatcatttgctaagtctctggctatgagccttaacgttccgttaattgaagtaaatcaccttcaagcccacattctggcccatttcatcgaagatgcaaatcctgtgccgcccaactttccttttttatgtcttacagtaagtggcgggcatactatgattgttctcgtaaaagactatttcgatatggaaatcattggaaagaccatcgatgatgccgcaggagaagctttcgataaaataggaaaaatctttgaccttgattaccctgccggacctatcattgacagactggccaaagaaggaaaccctaatgcttttcaattcaacaaacccaaactggagaactatgattattccttcagcggaattaaaacttcagtgctatatttcattcagaaagaagtcagaaaaaatcctgattttatcaaggaaaatcttaatgatctttgtgcatctgtacagaaatccattattgagatactgatgaataaacttgaaaaagcagccaaagacctcaatgtgaatgaagttgccatcgcgggaggtgtttctgccaattctgcattgagaaaagctatggaagacaataaagaaaaactgggctggaatatatacattccaaagtttgaatatactacagataacgctgccatgattgctatggtagcaaagctgaaatttgaaagaggagaatttacagatctcagaacaacggcaacggcaaaatatgatttataaggatgcggagccacgaagtggtgacgtaaaaagcaaagggttttagccctttgagatagagataaacaggctaattgtaaatagctacaaagtagcgggataaaaatgggacagtctcttgttaaaaattatgttcatattgtattctctaccaaaaacagagaaccaatcattgatgaagaaatacaggaagaattattttcatatctggcaggaatctgtaaaaatatggagtgtaatcccgtaaaaatcggaggctataaagatcatgtttacatcctttgtcttttatctaaaaaagtaactcttgtaaagcttttggaaagtttaaaatctcattcttcaaaatggattaaaactaaagataaaaaatattcgcatttttattggcagaatggctatgggtgtttttcagttaatccaaaagaaatagacactgtaaccgaatatatcagcaatcaaaaacaacatcatacaatcaaaaatttcaaggaagagtttttaatgtttcttagaaattataatatggaatttgatgaaagatatgtctgggattaatatttcgctctttcagagctcagataaacaaacattaattcagacaaagacctgcagtctttgctaagtattgtgccacttggtggctcttaaaaaaaataaaatgaaactattctacggagaaatcaacggaaataacgtaataatcaacgatgaagagcagcagcatattgtgaaagttcttcggatgaaagatggagaagatattcatgtaacagacggcaaaggaaaactggcttccggaaaactgattatagaaggaaagaaagctggtattgaaatttctgagatcaaagaaaatatgcctgaattcaatcccaggcttcatattgccattgctcctaccaagaatattgacaggatcgaattctttgtggaaaaagctgtggaaatgggcatttctgagattacgatcctgcagactgagaaaacagaacgtaaaaacgtcaatattgataagatcaggaaacaggctgttgcggcatcaaagcaaagtttgagatttcattttccggttatcaatgatttaattaaaattcaggattttctgaaaagtattgatccggaacatacatttgttgcgcactgtcatgagaacttagaaagaattgctctgaaaaatattcctcagctagaaaagcttacatttttaataggtccggaaggtgatttttccgaaaaggagattgcatttttagcagaaaataaggtaagagctgtatcacttgggaatcaaagactgagaacggaaacagcaggcgttttcgtagcagcatggaattattataatatgatataaatatgaagagaaggttgagcaaccttctcttctttatttcagattgactatttccagtcaatattattttctctcagatatttttcaaagatctgctgtccgcttctgattgaattgacagcccaaagtattttcattcttaaaagcttttcttcattcaatttataatcaatatcagattttataagcttctgcttcaattcatacatacagattgaagctgccacagaaacattgaagctccttgtaaagccatacatcggaatagccaatgtttcatcagcaaaatctaaaatttcctgggaaacaccctccatttcagttccaaaaaccagagcaataggttcagttacttcatattcaggcaacattttagcattcttttccagtgaaacagccactattttatatcctctgtctttaatattctgaaaagattccatattccggggaagcttttctacttcaacccatgtgtccgccccttttgtgacccgaagattgggttcaaaactgtattcttcctgcaaagccactactttatggaaaccacaggcctccacagaacgtacgattgcagctgcatttctgaactgataaacatcttctactaccggaagtacaaaatctgaactttccttggaaaaatgttcgattttcgtcagtctttcttccgttaaaaattgttttaaatattcataagtttgcgataaatcattcatctgcatttagttatttttttcaatagccctatgaaaccgctacaattttcattttatttttataaaatttcaagataagcgtttcattcattttcaaatctttgcaaattaacgtaattttgacctatgaaccctaatcgggctccaattcttaattaaaattagtacatgaagcgaaaagtcctgctcatctataccggtggaaccatcggaatggaaaaagattacgaaaccggaagtctccgcgcctttgattttggaaatatattcgaaaagatgcctgaaatgaggcttatggaatgtgaagtctttgttcatccttttgccaaaccgctggactcttcggatatgggacctgaagaatggagagtgatcgccaattatatccacaaaaactacaatgactatgacggctttcttattcttcacggaacagacacgatgtcctacactgcttcagcactgagctttatgttgaaaggattaagaaaacctgtgattatgactggttctcagcttccgattggtgatctgagaacggatgccaaggaaaatcttctgaccagcctttactatgccagcctgtatgaaaacgatgaagcggttattcaggaagtagccatttactttgagtacaaattattaagaggaaacagaacattgaaatattctgcagagtattttgatgcgtatgcaagcccgaattacccgattcttgggcaatccggagttcatttgaatattattaaagataacctgttccgttgtgatccggaggtggaatttcatgtggatgagtatatttctgaagatattttattctggagaattttcccgggtatgcatttgagccacttcaaagaaatccccaaaatgaaggttctgatccttcaggtttttggttccgggaccattttcagcagtgcaaaaacacaggaaacgcttcaggaaatcagaaataacggaactgaaattgtggtggtaagtcagtgtatttcaggaggtatttcattcggaaagtatgaaaacagtaatattttctcaagaatcggagccatcagcggaagagatatgactgccgaaactgcgattactaaagcaatgcaccttattggcaatccaagctactccggaagcttcgcagataatttcaccaaaagcctttgtggagaaattacggattaatttgtaagaataatttggatattaaagaaaatacactatttttgcaatctcaaaaagaaaggtgtccgagtggttgaaggagctaccctggaaaggtagtatacgggtaactgtatcgagggttcgaatcccttcctttctgcaagaaaagtcttaagtatatacttaagacttttatattttatgctttaatttaaagcttaccacttagtgtttttaaaagctaaaactcactttttacaacactttagaccaataacaagtcatttttttgccatagcaacaaattttacaatgtactactcaatctccattggttcatattgaatattttgttgttttaatactattggtgtcccatcttcattataagccttaccagtataaaaagcattaggattctctttataagttcgttgtacatttctaaacttttctcttgtagtccttaatatacttttctcatttcttagataaataagcttgggggtttttgtaattcccactgcttcaaaagtatatttcttatcagtatcttcaacttctaaaattaaaccaggtaatcctccaaaaatataaggtccattattaataggtatgccagtggtgtaccatgcaatgtaatttcttcctctatagctaactgttgccttattacacttatgccctagtaatattttttctcctttctctaagttccagttaagttttggttggtcttcctcatattgatatatagatttgaacctctcctgaactgtcattatattattatttttgaagattatattattccataaaactcttattttcataaactcacccatttctttagagccaatcatgtcctgtttactatatttttcagatagtgaatcctttttcaactgattataatctaagaatttagaaacatgatctcccaactcaagaatacacatcacctcttttttgctactaggagagagggcattatctaaaaaatttactttatagtatatattatacgaacttgttccataattagccacttcataaggagaagttttaattgaaaaattcggcgaaataatgccctgcccactaatgaatacaataataaaagaaaatataaatagatagaatttcataatttcatataaataaagaatcagcaacttaacagttactgattcatggttaaaataattttttaatattacgtatactgaccagtaaatgtagatgctccagcacattgttgattagtaaactgagtagccgccgcatctagctcctcaaaactagaataatcacctgcatccagataaaatacttttccacaccaagtagaaactcctatccaattataaaaagcagcttttactttattagaagtattgctattaacagatttattatcagtagtttttgcttttctgattactttgttatcagcactacctttagcactcataaatcctgctacaccaagagcagcaataaagaatatttttttcatcgttaaaaatttaattattaaataaatatttcagattgcaatctgcatcaattttattaaatatttatattattcacaacaaaaaatacaaatattttattatgttaaaaaaaataaccaattttaatatacatttcataataataatttcactaaatacaaacaatactaattacaccattaattaatttcgatgaattaggattattttctaagtatttctactcatccagataattggtaatttatacgctacactatttgctttgttgttcgttactttgaagtataatctaatcaccaaaaaccaacttaattatgacatcaacaagtgtaaatgcaaattcttcaggtcagttagtactcggaaacggagcacaattctgggtgtatctttcaccgcaaaatgatacctctaaaatgatctctacatggcgtgttaccttctcgcaaggagactggagtgactttatctcaagtgagaatccgaccaaacaaatccaaacccctaatctttcagggatttttgatatcagagtagaattattaagcgggtctaccggtacatggcgtcagatccctcctcaaacaggaagtcacaatgaaataggttgtaattccaactgtgcttctatggtaggcattgttgcagacagtaccaaccctcctatcggagccatcaatgcccatttctggacaacatgggatgcgatgtgcggagtaagacaaaactgataataaacagtccataaaacaaattgccacaatatgtagaatattgtggcaatttaatttcaatctggcaatggatatttacaataaaaaagaccggacttttaatccggccccttataattgtacttatttaaaactttaaagaaacacttccaagaaaacgtgacggagcctgtggcgttaaacgtacagaccatgctttttcattggtaatattatcgaatttcaggcctactctgtattttggctgatcatagaaaattcctaaatcaaacattttgtaagccggaataatcactttagccgtttgtgtattggtttgataggaagaggatcccatatttccaccaccgcctattcctaagccttttaattttccttcaggaatacggtagctgacccagaagttgaacatattggcaggtccggacaatgcaggccttaagccatttaccgaaggattggcattggtaaatttactgtcattataagcatatcctgcaacaacattgaatccatcaaaaggacttgcagtcagctcagcttcgaaacctttacttacctgtgttccatcctgtatggaataattgatatcatcaggatttgttcttaaaatattatctacacggatattgtaataacttaacgtacctaccagtctgtggttaaaaatatctgcttttactccaaactctaactgattggcatattcaggtttgaaggtattcccgttgatatccgttccgcttacgttattaaaaccgttcataaagtttccaaacaaggaaactttatttttcaatatttcataaacaattcccattttgggtgaaaaagcggtctgttcataaggtcccgattgtgctccactgctgcttaagccacctttgatttctcctgtggttatatcatacactcctttgaactgaaaccggtccacccttaaactcgccattaccataagctgatccgtaatattaaaaacatcagaaacataagcagcataggtattatcactgttgttttcccttctgaaggctgaagtagcggtaagtgcatctatcgtattgctattcactctgaagtcagtcgaaggatgaacaaaattaaataccttggtattggtatggtaacggtcaaaatgattggagttattataaaaatccaatccgacaaccattctgtttctgaaacgtccgatacggaaatccccgatgaagttctgttgaatattggtagcaataaatgaagtcgttcccaccatcacctgagcgcttgctgtagaatctgttttcccgttgatggcagaaatatatccgttaatggtagatcttgcgcgggatagtattgtttgagaagtccagttttctgaaactttataattaagctgggcgaagatgttcagcatctgtgtttcgtaagccagatcatcactcaggaagtttttataatacgggaacttcatatcagcaatagactggattttgttacttccggtataaggattaaatcgtacaaccgatgttccttttgcctgattgaactctacatccaacaggagcgacatacggtcattgatctgataagaaaaactgggagcaatagccagtgagttggtaaatccgatatcctggaagctcttctcggtggttcctgccgcattaagacgaaaaagagctgttctgtccttatttaccggtgtattgacatccacagtcagtcggttataattccagcttcctcctacataccctacttcaccgccaaaattattgtaaggttttttcgttaccctgttgtatactcctccgtaactgctagccacacttttcccaaataaggtagctgaaggtcccttaatagcttctatacgttcaaggtttacaggatcaatcactgaaaatgcagctcctgcaactccatttcgggcattgggttctgtttcaaatccccttgagcggaatgtcactcttccctggttggcaatcataggaactccggcacccggtacgtttttggaaatacttcccaaatctacagcaacctgttcctggaataattctttggtaaccgtattgtatacctgaggattttctaaatttttcaaaggcaatctggctacaaaaccgctttcttttttcgaaaaacggtttgtatttttcattatgactacttcctgtatagcctgtatattttcctgggtaagctgataatccagtgttgttgtttcaccagcttttacctccaccgggaggcgcacttctttagctcccagaatctgtaacttcacagtataagaacctgcgttcaggtttacaaaatgataatttccttcgtcatccgtaagggtttgccgattcgcttccggcaatgagacagatattgccctcaatggctgtccgtccaccatatttacttttcccgagattccgccctgcagattctgtgcttgtattgctgttaaaccggttagtaagaataataaaataagaaacggctttacgcattgctgattcttggttgaaatatcattctgtcttgtttctacggaatgaggcatatgcttcccgggaaacatacattcattaggttgtatcattttttcagccttatttaaagtgattataaataaaggtgcaaaataacggaatcgaaaactctcccacaacattaatttgaattattctaaataaatataaaaatatagcttcgaccttaagtaaatttttatagacttaaataaatgtttaggagattatttacttttttaaaaattgatgaaattaacttttccacaaactgctaacatattatccacatcttatccacaatccgttttaaaccctattcctaattctatcctaaatcaagttcttgttttgtctcgtttttaaacagtattgaaagattttgaataaacattctatgaaccagacttataattttgctgtgataaagtattctcactatgtaactgcggtattctcttctatcttacggtctcgcagtcatttaaaattaacagtaaaacgactatccgtcatattgggcatgaagaaaatttttgcaggtatattcttattgggatgtataggaaccactatcaaggcgcagatcagtccgccggggctgggagacgccaacaatgcattctggggtgcctttggagttaaacagcagctggattctttagggaaaaagcaggctttgagctatgttgccatcgggagaaaaagcagcccggataaccataatttattttcaaagcaggctatcattgttttgaatcatgaggtataccactcttttgccccgcatcagcaatacagctatgcactgagttaccgcagacaaccccactatgagaataacactccttatgaaaaagaaaataccgaacaggaattcaggatctacggaagatatgcttacacttttgatctgggaaaaaagtggaagctgaaaaatacggtccgacaggaattcaggaagttttttgacgcagactttcataaagcagaggaagattttcagctcagaacccgtatcaagagtcagttaacctataatttatctcctaaaaataatcagaagctggctttaagtgcagaagcattgttttccataagtcatctcaacgagccggatgctgaatggagtgcctttggatatcgtgaaatgcgtattgccgcttattatatgtttacaatcccaaactctccttttacagtagatgttggctatatggatgatctgatcagagacagcagaagtattcatcatggaggcgttcattatcttgctgcagacctgatctggaatataccttacagaaagaaataacaaaaaaaccacctttgtacaaacaaaatcccgatcatcactgaccgggatttttgttgaaacataagtttccttgcaatataattaagtatgaatgtttggtgtaacgtttagttgcaaagcttcaggaattcgcggctcatctgtacattaaatttagcttccgctttggagcgggcgtaaatcgtatgtttaaaagcatgtaccattttcagtttctggtcaataaattctgcaatctgcaccacagagaacaggaaatccctgtacaccgccatattgaccgtctgcccataatacggaaggtacgcttttaaaaagggtattgctttctgatggcggttatagctgatgcaatatcctaccccttctactgaggtaacaatagcatagttattaagataatcatgaatatttttgttaccgtccagagcctgaggattttttgaacaaaacttattgatcttatccagaatgtgctgggcgtactccatcatggagatatttttaaattcaaaaacctgattcatcctgttggcgggtgaggtttcgttttcgcaatcaatacagaaagaaatccctattttttcatggtaaggaaaaaagcagtctttcacttcaatggaggcatccggctttaacctgtcatctgtaaaattgtaatagacatatggactgtaaagttcagcaagcgcattcaggtagtctgtttcgctggtattatgatattcttcaaaccatttttcaaggttgtcataataattactttcgaagtcgttaaagtttaagtaaaatggcaattccatagctctgtaattttgatatgacaaagctatatccgtaatgcgacaaaacttgacgcaatatattttttgtgaaaaatttttggttaaaggtcaatttttgattcgcaaagtcaatcctcaataattattaacgctgatgttctcaaagtttattaatatacatagcttatttgttcgcaaaggcatttcatttagcagagagacacactttttctttgctgattgaaacgcctctgcgatcgaaaaaaataaacatcataaaaaactttgcgaacgctgtgtttaataagatgcgaacttattaaaattcacaagcacagcgaaccgaccgttcaccattaacatttatttatcataattcttcatcacatactcaaagtaatggatcattttcagatagttttcgatgctgagatattcattggtgctgtgaatactttgctgttcggcactgttgatcttgatcggcatgaaccggtaaacgtttttacttacgatttcatatttaccagcatctgttcctgccatggtaaggtatggcgtaacaatcgctccgggatgaatttccttaacgcctgcttctattattttaaaagcttttgtattggttggagaaatagcagaagcttctctggtattgtcaatttcttctacttccacatcaaaaccttcagtggctttcgcaatatgatcttttacatctttcactgaatttccgggaagcagtctgaaattaaccacaaattccacttcaggagaaagtacgttggtcccgtcacttcctttcatcatcgttaatgctgtggtggttcttaccaatgcattggtggtattgtttttggtgagctgtgagatcaataccggttttaaaagccattgattggccagcgccattcttgtggtaaaaggcatttcaccgccaatattattaaagaattctttgattagaggggtaataactggtttcatctgatcatcctccaaacgctgcatgatgacagctgctttcccgatagcactttccataggaggcatagaggaatgtccgccaagaccttttacttttatctttgcggacaggaagcctttttcagcacatcctactacggcaacatcagtatcaattcctgctacatttccttttctcatgatcaatcctccttcgtcataaacagcatcgaatttcaatcctttctttttaaaataatctgcaatctgaacggctcctttttgcccgcccacttcttcatcaaaaccgaaagccagataaatatcacgctgaggaatctgtttgtttttaatcatagaattcatagattccatcaacgagaaaagcattcctttcatatctattgctcctcttccgtagattcttccattggctaccgctcctgaaaaaggggcaaaatcccagtcttccgctacttttgaaacaggatcaagcggtttgtcatccggccggaatacattttcttcattatttttgacatctgcatctccgggaggaacaacgtccatatgggaaaggaataaaatgggttccagagcaggattgcttcctttaagcctgaacaccaatccatactgattcacctcaacattttctgtattctgataaactaacggataagatgtttttaaataagctttgaactgatcaaacggcgcatagtcgaattcacccagactacctgtagaaactgtgggaacctttattcctcctgacagcctcattaccgcagagtcattttttacaggtttccaaccttctcctgctccgatattatttttcttaaacggataagtataggttttaatcaatacaacagcagccagaacgacaatgattcccagaaggattaaaagaaattttttcatagtagatagtttgtgaagtgattttattcaataaatatagtaaagtatagggtgtctggcaatttaaagctatgctttttcaaacaacccttatcatttaatgagataaaaataaacagataggtccccttaatgaaagcaagatcgtcatcagtataaaaaagtatgaagaatattctgcacattatctccagcgcaagaggagaacattcttatagtaaccagctaagctcagccattctggaaaaactgttacaaaaaggtaacatcaataagattactgtacgaaacttagttaaagatgctcctccatatgcagacgaggtgtccattcatgagttttataaacaccctgaattatacgatgaacaaagcgggcagcttctttcgtacgcgaatctgattgtggatgaagtgcgtgaagcggatattattatcattggaacaccggttttcaacctgggaatttccacgcctctgaaagcctggcttgaccagctgatccgcgtaggaattacttatgtttttgatgagcaatggaatcgcgtgggccagcttaaagggaaaaaagtatatctagctgttgcttccggtggcagaagtactgaaggtgcaacggattatatttcagcttatcttggggatgttttcagaagttatgcaggaattacggacgtagaaacttaccgcattgagggaaccatggaaaacggatttacagcggattatgaaagtgtgctgaaagattttaattccgtcaatgaaatgctttaaagcgggtgttattgtaaacgcaaagttttctattcttaatgctgaatataagggagcaaagatggaatcaacaagttgattggatgaagctttatgatttcaatggtgtttattattttgttttaacgcaagggcgcaagggactttaattatgatacgttttttaaggcgcaagaaaatcgaagattttcagcagggaaataatgtgaaaatttcatcagcaaaactttgtcgtctttgcggtttatcaacaacgaataaacatctttaattaattcaggatttcattcatttcggttaaaatgatgggttttccatcggtaattacaatggtatgttcgtgctgggccatgtaaccgcctttattgcctaccatggtccatccgtcttttaattctacagcaattgtggaatctgtggagataaatgtttcaatggctaccacagcgtttttcttaaaacgtctggaatcaaaacggtttctgtagttaagcaattcatcaggctgctcatgtaagcttcttcctactccatggcctgcaagattcttaatgactttaagacctcttttcttcgcttctgtttccattaaatgtcctatgtctgctattcttacaccgccttttatattgctgatcgcctttctaagaatgtctttggatgcctccaccagtttctgatgtccgtgaatatcttttccaatgataaaagatccgccgttatctgcccaatatccatccagctctgcagaaacatcaatattgatcaggtcaccttctttcaacactctttgatctgtgggaataccatggcagaattcattatctacgctgatgcacgtccagcccgggaatccataggtcaggtaaggtgctgattttgccccgaaactttccagtattctagctccgtattcatcaagatcttttgtggttatgccgggttcagcatattctgtcatctttttcaaagtaaaggcaacggcttcacttactttttgcattccgagcatctgatcttcgctggtgattgacatatttgtttgtttattgttgagaactacaaagttaggaaattaaaacgttctgagatagcctgttttcataaagtagcagagagcatttatggagtggctcgtgatgctttaagaaaaaagtaaccgcaatgcgaatattttaccggacattttttcacctttactttacagaatgtattatctttgagtcttcacaaattgattaaagaatggatcacaaaatacatcagggaagaaatgtaaaacgtttcagagaaatgctgggcatcaagcaggaagcattggcacttgatctgggcgacgactggaaccaaaaaaagatctctttacttgaacaaagagaaaccattgaaaaccaactgctggaaaaaatatccgaagtgctgaaaatccccgtagaagcttttcagaattttgatgaggaacaggcggtgaacctaatttcctgtacattttcagataatgcaatgtttaataatagaatcgaagttcaaaatattaatcctattgataaaattgttcaacttcacgaagaaaaaatcgcgctttacgaaagaatgctgaaggaaaaggacgaaatgatgagcagactggagaagctgcttgataagtaaagctttttgagataaaactttcaataaaatgataaaaaccactgctgttagccgtggttttgttttattatcctactttggaaaagaattctgctctccgaagtctcctgactttggagcatattgtattggaattacttttgttattggctcaaagtcgggagacttgtgtagcgataaatttaactttttttttaacaaacctgtctgaccataaatttaatttaatacaaaaatatttcttttcagcgacagaacctgtcgcataaaaaataaaaaagggccaactcaaaagaactgacccttccaaaaaacattaactgtttattgatagaattatgatgttttatttccagccgccacctaaacttttatagatgtcaactactgtgctgagctgtttctgttttgcctcaataagttccattttagcatccagtgcatctctttggttcaaaagaacttcaagataatctgctctggaattacggaacaactgattggcaatatcaatagactgatccaaggctttcgtttcctgagactttaactgataatactggtctatatttttaaccttcgacatcaggttggcaacatccagataagcattcagaatagttttgtcatattcatacaatgcctggatctgttttgcatctgctgtctggaaattagcttttatcgcacttttgttgatcagcggtcctgccagttcaccagcaagattgtaagcaattgattccggcattttaacaaggtatgaaggtttgaatgcctctaaacctaatgtagccgaaatttccagggaaggataaaattcttttcttgctgcttccacatccagctttgaagcctttaattccagttctgcctgtttgatatccggacgattggccaacagctgtgacggaatcccggtatataccgtttgaggaatagtagacataaagttttccttcgttctaacgatcggttgtggatatcttcccagcaaagcattaatttcattttccttctccgtgatttgttgacggatagtatattccgcagctttggattttgccagttctgcctcgaatttcttcacagcaagttctgttgcagcagcagcttctttctgaattttggaaatttccaatgccctttgctgaagcttgatatactgctgtataatatccaactggttatcaagtgccagcaattcataataattatccgcaacttcttcaataagattagacaggacaaagtttttaccttctactgtagaaaggtaatgagctacggcagattctttttcggttctgagttttttccagatatcaatctcccagctcgcatttaagcctgcttcaaaatttccaagcggatccggcatttccttgcctggctctatttctgtggtagcatctccggctccctcgctggtatagcgtccggattttttcagtcctgctcctactcctgcagaaacggttgggctcaatcttccttttttagctaaaacaccacttttagcaatctcaatctcctgaagagtgatcaacagctcctgattattttttaaagccgtttcaatcagggttacaagatttggatccgtaaaaaactgtctccacggtgttgttccgctattattgttagcgtcctgctgctcttcctgattaaagttctgaggaatattttcttttacctcatcttttatgacagtcgccatgggcgccttacagcttgcgagtacaagcgataaggcaatggctgtgattatatttttagtcttcgaattttccatcatgttcataaggttcagtttgttctgttaaaggattctcttcttcatatctcgccaatcgtgacttatcagcaatggttccgaagatataatacaatccagggataatcatcagcccgaaaacagttccgattaacatacctcccgctgctgcagtaccaatcgttctgttaccaactgctccaggccctgttgcaattaccaatggaatcaatccggcaatgaaggcaaatgaggtcattaagatcggacggaaacggatggcagctccttcaatagcggcttttgccacaggaattccttcttcggctttcttctgtacagcaaattcgacaattaacaccgcatttttacctaaaagaccgatcaacattaccattgctacctgagcatagatattgttttccaatcctaaaagctttaaacataaaaaggctccgaaaatacctgtaggcagtgataaaataaccggtaacggaagaataaagctttcatactgtgcagaaaggatcagataaacaaatcctaaacacacaaggaagataaatacagcttcatttccacggcttacttcatctttggaaatacctgcccagtcgataccaaagcccctcggaagtgttttatcagcaacttcctgaatcgcctggatcgcctgtccactactatatcctggggcaggagttccgctcacctctgctgagttatacatattatgtcttgtaatctctgataatccgtatactttttcaagcctcataaaatctgagtacggaaccatctggtctttatcatttttaacatacagcttcagcaggtcagtcggcagggcacggtattgagggccggcctgaacgattaccttatacggtctgtcaaaacggatgaaacttgtttcatagttggaaccaatcaatgtagagaggttatccattgctttttcaatcgttactcctttttgctccgcaagatcattgtctatcctaagcatatactgcgggaaacttgcagaatagaaagtaaatgccgatccaagctccggacgctttttaagttcttttacaaaatcgttacttacctgctccattttgtgatagtctccacttcctgctttatccagcaaacgaagctcaaaacctcctgcagctccatatccgggaacggaaggcggctggaagaattctatattagctcccggaatatttttggctttttcttccagcttttcaatgatttcggcagcagattctttacgctcttcccagcttttaaggttgatcagacaggttcctgagttagatccggtaccttcggtcaaaatctcgtacccagcaagagaggaaacggactgcactccatcaatatcttctgattccctcaaaagttctctggcaatctgattggttctttccaatgtagatcccggaggtgtctgaataatagcatagatcatcccctgatcttcagccggaataaatccggatggtaaagagttgctcaggaagaatgtgcatgcacagaatgctaatagtaacggtaacgttattgtctttttcgtaactgttttgttcagcagtttttcatatctccctgctccttttgtaaacaggttattgaatttatcaaggaaaagtgtaaccggagttttctttttagcttttccgtgattatttttaaggatcaaagcacacaatgccggtgtcaaagtaagggccacaacccctgacaggataatggacgaagccattgtaatggagaactgacgataaaataccccaaccggaccggacataaatgcaatcggaatgaatacggatgccattaccaatgtaatagcgataattgctccactgatctcatgcattgcttcttctgttgcctttaacggggaaagatgcttttcttccatcttggcgtgaacggcctcaatcaccacaatcgcatcatctactacaaccccgatggccattactaaggcaaagagtgaaatcatattcagcgtaattccaaaggcagacattactgcaaatgttcctaccaatgaaaccggaactgccagtgcaggaatcaatgttgaacgccagtcacccagaaacaggaataccacaatagcaaccagaacgaaggcttcaaataaggtatgaataaccttttccatagaggcatccaggaatcttgaaacgtcataactgatgtcataatgcattcccttcgggaagttattcttttcaaggtccttcatcagggctttcacgttcttgattacatcacttgcattggagccataagattgtttcacggtgatcgctgcagaaggttttccgttcaatgttgaatagatatcatacatggaacttccgaattctatatcagcaacatctttcaatcttaccgattctccgttaggttttgcctttaatatgatgtttccgtaatctttttcgttgttgaaacgacccggatatttcaatacatattcaaaagactgtgagcgttttcctgaactttcccctgttttaccgggagatgcctccaaactctgctcattcagtgattccattacttcatcggctgaaatgttgtacgcagttaacctgtcaggcttaagccagatacgcattgcatattcacgggttcccaggatatcagcaaaaccaacaccgcttacccttctcaattcagacattacattgatatctgcgtagttgaaaaggaatttctgatcagcttttggatcatcactgtacaggttaatgtacatcaacatgttaggttcttcacgcgtgatttttaccccttcacgtaccaccagaggcggaagtttattgactactgaagatacacggttctgaacgtttactgccgctacattgggatcggttcccagatcgaatacaatctggatagacgcttctccgtcatttccggcatctgatgtcatatatttcataccgggaaccccgtttaaccctctttccaaagggataacaacggatttaatcaacaattcgttgtttgctccgggatattctgcggtaatatttactttgggtggagaaatggatggaaactgtgtcaccggaagttttaccaatgacaatatccccataaatacaataatcaatgagattactatggacagaactggtctgcgaatgaattttttaaacatactgcttcattttagagaccactactctgcttttaattttaatgattgaagaactttcttaggatcctggaactttgttttcaacttttgatcatcctttactttctgaactccttccagaagaatctgatctccttttgagattcctgagcctaccacataaagatccggaagttcataagctactttgatatttctggactttgctactccgtttttatcaacaacaaatacgtatttctggtcctgaatttcataagttgctttctgtggaatgatcagtgcgttatgaacaggcattgacatctgtattttacctgtttccccgtttcttaaaagtttgtctggattagggaatttagcacggaacgcaatatttcctgtttcgttatcaaattctccttcaatagtctggatttctcctttctgtgtgtaggtttctccgtttgcagtgatcagagatacctggttgctgcctctgtctgctgcatgagtctgataacttaagtattccggttcggaaacattgaaataagtataaatgcttgtgttatctgataaggaagtcaatagatcaccttcatccaccaggcttcccagtttcagaggaattctgttgataacccccgaaaacggtgctttaatatcggtaaaggaaaggtggatctgagcaagcttcatttctgcattggcagcatccagcttagcttttgccatagctctttcatttttggaaacaatattatttcccgctaatgtacttgcgtttttcagttcaatagaagcctgttctacttctgcttttgcttttaataattctgcctgatataatttaggcataattcggaatagtgtctgtcccgcctgcacgtattgtccttcatcgacaaagattttttccagaaaacctttttcctgggctcttacttcaatgttttttacagattgaatctgggctacgtattctttgttgattacagtatccattactacaggggatgtcaccggatatacggtaacttcttctttttcttcttttttcttattgcagccaaccgccagcagaagggcactcagcgcaattcccgaagcaactctttttatcataattctagagtttatataaatcgttaatgttttgaatagaaataaacggtaataaaaggggtacggtgtgctgattaccaacatttacacaacgtaaagtatttccacccgtaaatcaggcagaaaaagaacagatcatgaattttaaattctaatggaacgaatcagaataaatcttttggtggcaaagccaagaacaaagccgtgaatatcgggtctgaaccgtttgtaactttttaatccaaaaatatagaccaggctgaaaactccggcaaaaacaacaatagcctgccatacatcagatagctggaaatcattttcggtaagttctaaagtggaattgtctacattgtcggccatctgctgaacggaaagcttttcaaaagtctggttcaggcggttggctcttttgggcatatgatgagaaacatgaccggtatagtcatttcggagagttttaacgttgatcctgctttccactacaaacagcagaaaaagaccggttaaaaagtatactataaagtttctcattttgaagttgcaaatgtacacccagtttatgatattatcatagcagattaacaaaatttaactctcctttaaattagctgaataaaaaagtttgaaaaatagtaaacatttcccttattcaggcataatccgggcaattctgaatatcacctgtgcatcttcgaattttcaaatattaagccacatttttgatttaaggaaattttaattttaaagttgttgcttttttgaacatttaaaccctgttaagctttgttttgaaaatatttttttaaattaaaatcaaaaatattaaaacctaaactttatcataattttagattattaacattaacttattgttcttctcttctttttgaattatttttgccgaaaattgacacaccaatgaaaaatgaagaaaaaaatacactattctactggaaacaaatccgttaaaaatcctgaattaacaatagctatactcaatattcactaataaattattatttcctgtttcgtgaataatgttcaaaaatcagtgagttaaatcgatataaatttaaaatttacgttactttatctaaaattaacatatttttaataaaaatatttgtaaatttatatagcattaacaccacaattcatgaaacactttaaaatcacttatcactatgaaaaaattattattcccggtcctttttggattgaccattgtttccctaacagcatgtaaacatcccggaaaggaagctgagaccattactgctgctaccccggaaaatacagatgagatcacaaaaaatgtgtatgttgacaactatggagaaaaaatagaagtaacaatcaacaacactaaaaatacagccacaatacatttaaacggcaaaacttttgacctcaaaaagagtgatgcattacctgaatatacagcctccaatgaagagtatcaatactctgatattaagggcaatataactttcctgaaaaagactgcagatatggtcttgtttcatgttaaacagtcaaaaaaagagtccggaccggcaaaaatggcatcgtattagcatagggaaaagcattcatattaaaaaaaataagcattatgaaaagtttatattattatttatcggcacttgttatcgcaacatttttggttgtttcctgtacgacacaaaacgcacaaaaaccaactaatgatattacaggaaaaacctggaaacttactgagttgaacggcaaaccaatagagctgaaaaatcctaaaaacaatccttatttcaaacttgaaatgaatggaatgagatatgaaggacatgcaggatgcaacggtttgggaggtacgtttgaaatcaaacctgaagtgatgagaattaagttcaatcagggaatgtctacgatgatggcttgtgaagatctggatattgaaaaccagtttaccaaagcaattcttgctgctgataattattctgtaaatggaaatactcttactttaaacaaagccagaatggctcctttagctaaatttgttcttcagtaatcgtatattattacataaaaatataaagacgcctcaatgtatggggcgtcttttttattacttacttttcttattgtacaggatataacagaccaaaagacttatatttactaaaacagcaaatgaatttgatagaataataggaagctcatcttttttaaatccataccatacccatagtgacagccctgaaataaggactaaaagcatgagcaacgagatatcttccacattcttttccctgatcacttttaccagctggggaatcatagaaacagaagtaagaatcccggccactatacctaatacattttcattcataattgtaagctttgtatatctgtactaagatacattattgaaatctgttcaatgatacttcttcatgcaacggaacattttcttcaataaaacggaataaatctctcgaaaaatagcagccattcaggataccacgagctcccagtccgttaaaaacatacagattgctgaatgtctgatgcctgccgataattggtcttctgtcttttactgttggacggaatccaaaatgtacttcttccacttcaaaatcatacggataaaattcagagagtccattgactaactgtgccaccgcagattcatcaatatgatgatgaagctgttctctatcatacgttcccccgtaaaaatagagcccatttccggttggaaacaaaaaatgtttcttcttaatagtgatattttcgggaatcggttgggaaagtttcacttttatatggtgtcctttattcggatttactgtaatttcagaaaagtatggattatcttttactcccatgccttcacagaagattatatttttgaagctaaaatccttatagaccgattcagaagggttcaatttcgtataatcaaatttttctttgatcaaatgaccatttttttcaaaataactgaatagaccactgaaaaaaccattgacattaagtctggcagactgattcacctttccggagagaaaatcgttttttactacgtttaagtgatcaaaatttttgtcaaggaaatctgataattcttcattttccgattttttaagccagagattctgttcgttctcatcatgaaaaattctatggataggagcattgatcaggtaattctctccggtataggattctatttcctgaagactttctttcagaaaatctatttgttcctgtgctttccagaatgtagtaaacttcttcaagactaccggattgataattcctgccgaaacctgagaagcactttttcttccttcggaaaagatcacaaaagatttgttatttttaatcagctgatgagccagaaaaagtcccgcatatccgtctcctacaataatataatctacatttttcatatgagaaatttcatttgtttaaaggtcatatgtaatcgcctatttcattgattgttgatcggtaataaacaaagggcgatttcataataaaaaaacctgagtaaaaatactcaggttttctataaatatcaagtgaaatctagtaattccacatatcattttccatttcaagaatctgtgctttgattctgtcactttcttccagctgctcatctgcatttttaggaatatagtctttgataacaccatctcctaaaccgcttgaagacttatagataatagaagaaaatcttcttgcattgataacatcatcgaaagatagatcagcagacgaattttttctgttgaaaacataattgtttgctaaaatatcacgagcacttgggtaataaatccagaataaatcgatcaattcatcagctccggccagaggctggccgtcaggaccaattcttccgacagatgtaggatccggacccatagcagcgataccaagtggtctgtacttcatctgaccatctcttttatcgataaaccacatacccattattttaagaacttttactttatcagtagtagttctgatgatatctgtaagtcttttcttctcgtcttctgtaagtgttcttccagagttcaggatatcgatagcttcttcgtcaagtcttacactttccagtcttttctgaatggcttcaggtgaaagtcttgtaacaaagttttcatcatcataaacttctttgatgtctcctttaagagctccatcaagtaataactgatataaagatcttgtagaacttgaaagaagaccatccggattatcgtaatagaacggctggttgatcttatcattcatatcaatgatttcccaaacaaacatacttttgtaaatatccttgtcatcaacgaaaccatattcaagaggctttactttattgctgataacagtatcccctgcttttctcattgattcagctctcatctgtctgaattcctcaggagaagcagcattcagaatagtttgggaaaatgcgaatcccgaaactaaaacgaaaagggtgctaatatattttttcataatatgattttacaaattaaccttattgaacattaataattacaggtgaaatttccttaagcctttggtttccaagccctgtagctgtcgcctgaatatcatagatctgaactacatcaccaggtctaaggtttctaagcataccttctgctcctgataatgagctaccctgaatcagagtacctgcttttcctggaagcttaataataaagctgttaacagtgaatgaaacagggaaatcaaagtctggtaaagtagcagtaacaatctggttaggtatagaacctgccggcataaagtttacagctttacctctgatctgaccttgtggtcttgggatattcttaattctatattcaaatacctgagaaactgttttaccatatggatctgttcctgataatgtcaacttcactacatttcctgtagtaggagtaacattccatttaccctgacctgtactcttcacagtagctcctgctgcagataatgaaagtttagaattgtcagcacctaagattgatcctgaaacagggttctcaagtcctctatacattacattcatcttatcagcagaaagcaataatcctttttcaagttttacttctcttggtcctgcaattacattataagtatgcgtccaagggaaagactgtggcttccctgaagcatctgttaatgtaatagttcctcctagtttatgttcaccgattccggaacctgaaatctgcatgatacctttaccgttttcaactttgcttactccagaaatgctgatcttgttactgttagaataagttcccaacattacttttacttcagcctgttttcctgcctggatatctaccggacctgaaacaataggctcatagcttgagaatttgatattcgcatctactttttcctgaagtaatagtgccaatgcatccgactgaacgtttctggcatcattttggataatttccagattagatattgcagcgattaacggctgatggtaaaatttattctggaaccatgtcttttcatttggagatgttcctttaggatactccgcaataagagacttattagctctggctactaaatcctgtaactgagaattgcttccaaaagtagtattgatgtagtttctaacgtcatcaattttagctttcagatctaatgcattcttcgaaggggtattttcatctccttctttaaagaagtattcagttgttgcttcattgttgttcaatgcagcaaagttctcacttacatcaatatcttttcctgttttaggatctttgtcatgaaactcagattgtttcttcaacaaatctttaacatcctgagcagattttactaacgcatcaattttggttttcaatactttgtactgagcccaaggctgtgcgtaggtatccggaacctgctgagccttagcttctaaagttctttcaaagatcttctcgttttttctttctgttaaagttctggtttcattcaatgctctggtagagtcatagtatgatctgatgatttctgcatcaatatttagggccatcatcgcgatgaacaccaaatacatcaggttgatcatcttctgacgaggggtctgttttccttgtgccattctcttttctttgttttttaattaagtagttaaatttagaaatggttaggaattaagacttcatagcagttagcataccaccataaactctatttaagttattaagattagttgttaaaccttgtagctcttgattgaatttctcagactgttctgcagatttctgcatatccgcaacatacttgttagcaaattcagattgtctcttaccgctttcaagctgcattgcataaagagcattcatgctttccatgtgctgggcagctttgtttaattgctcattatatttatgggtagaagcagatacgtcaacagtttggttgatctgatcgacagagcttgagaatttatcaattcctgttcttaatctttcaaataactgaacgtctaatcttgcgtcttcaagcattttatccaatttgctggaaagagagttttctaattcagcaaactgagcacttgtatttttagttgttacattagagtgtaaagggtttgggttggcatgcttatccaataattcaggataaacattttcccaggcataagactcctcagttttaggtgggtcaaatgcgaaaatgataaagataatcgcttcagtaataagccctactgtaagagccatatttccgttaattggtcccagtgtaatgtgagtaattttaagccaagctccaagaattacaattgcagcaccgaatgaataaaagaaattcatccaagcatctttagtcttaaacatattgagttagtttttttaatattaaataaaattgttattgaaaaattgtctgattagtttctgttaattcttcttggcttaacagctgcttcaggaatatcctgtacagttctgaatccgatatagcttcttgcggaatcttttctttcccaatctcttgcaccagtcattagcgcataacctatatctttccaagatccacctcttacagatttcttcgtatctaatttatctttagtagaaggatttaacgtagaagtaaatccagctgaagagttgttgtatgaagatgatgtccactcagaaacgtttccagccatatcaaataacccaaatccatttttcttaaatttcttaactggagctgtatatgtataagtaccttttttctcgtcttccatgtagttacctctcttaggtttgaagttggcaaggtagcaacctctgtcatccattaaatatggaccaccccaagggtaagtagcattttgcattccgccttttgcagcgtattcccattcagtttctgttggaagacggaactctaatggtctttgtttttttctttttaaactttcgttgtaatctgttttcaatttagatctgaagttacaataagcccttgcctgatcccaggtaaccccaacaacaggatagtctttataagccttgtgccagaaatactgttcaaacaatggctcattgtaagcaaagtggaaatcttttacccaaactgtagtatcaggatagatcgcaatactttcgcttttcaggtaattagctcctctttcgttatcagcaactgcagcatccatatctccccaacggtaagtatatttaagcttgcttacatctaaaattctttcgtttccgattcttgaggaagtaggcagatacatagattctaaaacttctgcgtattctacatccggatattttgatgtgctccagtgtaaaggaattttccaatctaatcttttgcttgcatcatagcctccgtcttcccggccaccctggccttccatatattcttgataaggtgttaaattttcttcttttttagcaaggtatgcataatctcctatgcttgcccctttacgtccgccttcatcaccgccttctccggcagcttcagcaagtaaagttcttgcgatagagtctcttacataattgataaatactctgtattctgcattagtagtttctgcttcatccatgaagaaagaagaaacagtaactgtcttcaatgctgctttttcaggtgtatttgtcggatcctggtctgctaaaccagcaacaaacgaacctgcaggaattgcaaccattccgtatggtctttccgcaacaaatgatttagttttttctcttggtatcaattctccttttgttcctggcttccctacagaagagctgccaccacctgaacaagataccgatgctaccgacgcagacaataataaaagaaatatccttttcatgttaatttttataattaagccgtaaatatataatttttttaagaaacttttaagattttttttgaaataacggaagaaatctaaatttattttatttacaacaactttttattccacggtaacagattttgcaaggtttctcggttgatctacgttggctcctctataaactgcaatataataagcaagcagttgcagaggtacggaagcaacgattggagagaaacattctgaagtttcagggatttcgataacataatctgccatttcgctcacctgacggtctcctttattaactacagcgataatttttccttttctcgctttaatttcctgaacattacttacaattttatcatagtgaccttttcttggtgctataataacaatcggcatgttttcatcgatcagggcaatcggaccgtgcttcatttctgcagccgggtatccttctgcatggatataagaaatttcttttaattttaaggctccttctaaggctgcaggatagttatatcctcttcctaaataaaggaaattggtagctttcacaaaatctttcgcaatattctgtgtaagctcatgagtagtatttaacacttcttcaattttcttaggcatagcatcaagctcagcaattaagctcatgaactcagcatttcctaaatttccgttgtgttttcctaatttaaatgcaattaaagtaagaatggtaagctgcgctgtaaatgcttttgtagaagcaactccaatctcaggaccggcgtgtgtatatgacccggcatctgtaattcttgcaatggaagaatctaccacattacatataccatatataaatgctcctttttcttttgccagttttaaagcagccatcgtatcagcagtttctccggactgagaaatggcaattacgacatctttatctgtaatgatcggatttctgtatctgaattctgatgcatactctacttccactggaattcttgcatattcttcaatcagatattctccgataagacctgcatgccaagaagtaccacacgcgataataataattctgtttgcatttttgaatttctccacatgatcccagattccggccattttgataatcccttcatcaacaagaagtctacctctcattgtgtcatgtacagatttaggctgttcaaagatctctttaagcatgaagtgctcgtaacctcctttttctatctgctcaagactcagcttaagctcctgaatttccggctcaattttagagttttcattgattgttctgatatctaccccattttccagagagattgttgccatatgaccttcttcaagataaatggcttcttttgtaaattctacgaaaggagaagcatcagatgcaataaagtattctttatcaccgattccgattgctaaaggagaacctaatcttcctaccactaacactccagggtaatcttcgtgaagtacagtaattgcataagctccgtatacttcattcaatgcatatcttactgctgtcgggaagtcaatatcaggattaagatccataaaatactggataaggttcaccaatacttctgtatctgtttctgatttgaaagtaaatcctttttcagtaagcattgttttaatcgtatcatagttttcgatgataccattatgtacaattgctatttttccattgttggacaaatgcgggtgggaatttctgtcactaggaactccatgggtggcccaacgggtgtgccccattccaattttagactttccttttagttccttggaaatatttaccaaatcttccactttaccttttgttttttctacttccagtttgttatctggactttccaaaacaattccggcactgtcataccctctatattccaatcttctaagaccattaattacaatttcataagcgtcttgaaatcctgtatatcctactattccgcacatattttattttgtctagtgttgtttgttgtttattgtcttctattttttcgtaccataagtcaccagtaactggattctttttggattggtattcgttttatctactcctgtaagaataattctgttcatgtcaaatgctcttgtcgtattacgaactcctaaaagggttcctgtagcattggcagcaaatgatccggcactgattattaaaggtttattaggaatcagctggggatttccatttgtatcattttctttcttctcttccacaagatccttgattgttttggttactacaaaatcataataaccaggattttctttgtaataatacaatccaagcccgtttgtaaggtctgaagtaaatttcagtgctgatgttgaataatcgatagctccattatttaatgtattggttaaaagtgtaaacctgcggtcttcagtagaacctgtatttttccatgtttcaggatccaggtacactctgatcttagcacttacaatacctgctttatctttattatatacatccttaagctgcgcaattgtttcatctttaatttttacgatcacagaaggaccacccattccctgaacaaaaagtcttgcatcaccatcattaggattacttgtagccaatgcagatgcaacagtcgaaccggatctgctgtattcatagagtcccaaatgcgcattagcacttcctaaattaaagttaagggttgtctgcggtcttgtggtagttccgttgtctgttttatcatatttataatacatgataagctgcagatcattaggagaaaactggtaaagatatttatccgtttcatccacagaaatttttatacctttaaaatacctgataaagttagcagcatcctgaagctcaggcttaccttttttatcaagaatatgagtctggaaaaagtccgtattactcaacttcattctaaatcctaagtttccggtaaatacgactgaattgtcagatttttttgtaatggaaacggaactgattttaccatcaaatactcctgatcctaacagttcaccagtacttatcgctttattggaacgtttgaaactgtcatcatttgcatctatgaacgtggttacttcatgtacattgattttcattgtttttgaagccactttaccgtatttacgaaccgggtaagttttcttctcaatggaaactgctgtagctactccatctaccgggaaatcacttttatcgaatgtatttgttttcaatgaatcactttcaaagaaataagtattcgccgttgtattcgctggtggtcttactacaaggaccacagaatctacttttggatttgctccgttaaagtcataattatctactggcattcttagctgagtaacataagaagctctctgcattccgaattggttttcagtaaaagctcctagaacgccaacataagtagcggcacctgattcgttcaatccactgatcagtcttgaagcatcacttttgatggaatctttattatcgtaattatatgctataacaggatatgaaatttcattgccttgtactgcatcaccattaaacagctgctcaccaagagaatccggatcaggttcacagttataaaggaatgtacttccgaaaaacgccatcaaaagtatggcgaatgtccttttaagattatgagtcattaaaatgtgtttttaataaagttgatttatagaatctatgtcaagatattccgacttttgggttgttgcttcgttgaaggccttatccaggtcttcatccagaaactcgtcacccttcacaacggcatccacatagttcatactttcaataacaaaacttttaatcgttgggttatctaacgcttttaatcctgaaatattatcaaattgcagtttttcactgatctttttatccagatcagcatctttctcattgtaaagagaaagtacaattttagcgtctttgaaataagtatctgattcgtagtaagttttaagataaattggaacaaaagaggacatccatccatttaaatgaataacatccggcacccagtttagcttcttaatggtttcaataactcctctggcaaagaaaatagccctttcgtcattgtcatcgaaaggatttccttcatcatcgaaataatattgttttcttttgaagtattcttcattgtcaataaagtaaacctgaagtctttcccccggaagagacgctactttaatgatcagaggctggtccaggtcattgataataatattcattcctgaaaggcggattacctcatgaagctggaactttctctcacttatttgtccaaatcttggcataaaaactcttacatcattgccttcttggtgcatcttaagtgccattttgtttaccactgcagccatatttgtatcttcctgatatggatacatctctgtagtaatgtacagtattttttgattcggcataaactttctatctaatttttgtaaaaatgctttaatgtgcaaaattacaaaaaaacatccaacattattttaattaacatttttttacgataattccctttttcaaattaataaaagcacatattattatgcgatatttttactatttttgaaatagtattaaaataaactatggaagttataaaaaacaggaaagttcttcaggatttcattgagagacagaaagaaatgggaaagagaatcggctttgcccctactatgggagccttacacaaaggccacctttctctgtatgaagaggcaaaaaaagaaaatgaccttgttatttcttcaatttttgtaaatccaacccagttcaataatcctgaagatctggaaaagtatcctagagatattaaccgagatatactcattcttcagaattccggctttgtagatgctgtttatattccggaggtagcagatatttatcctgaaaaggcagaaagtaagcactatgattttgatggattggaaagtgagatggaagggaaatcaagacccggtcattttgacggggtgggaactgttgtagaagagcttttcagacaggtacagccagacaatgcttattttggtgaaaaggatttccagcagctcgccatcataaaaaaaatggtagagaagaaacaccttcctgttaaaataaccggagttcctatttacagagcagaaaacggattggcactaagctccagaaaccaaagacttcatgaagaccgcaaagaagcttcaaaagtgatctatgagactttaaaaaaagtaaacgactggttcaggacggtttctattccggaaatcaaggaaagagtaactgacatttttgatgaccagccgggaatgaaactggaatatttcctgattgccgatgaaaacacattacaggaaactgattttttctataaagacagaaatttcagagcctttattgtagtagtggtagatggagtacgattaattgacaatatgcatctggattaatcattcagaattttaataatatatccctgactttttgttggggattttttattgaacaaaataaagataacaaaactgatttcatacaaaaatcaaaggcctcctgaaggaagcctttgaaacaccaaatcacaaaatattaatatgaaaaaaatttacttttcagtaaacttgtgacccggctgggattcgaacccaggacccatacattaaaagtgtattgctctaccagctgagctaccgagtcggtcacaattaaaatgaaataaatttcaatattaattataaattttctttgcagtgcctgcgactggactcgaaccagcacatccttaggaaaccaccccctcaagatggcgtgtctaccaatttcaccacgcaggcaataaaatcacaaaacagtaatctttattgctagtgacccggctgggattcgaacccaggacccatacattaaaagtgtattgctctaccagctgagctaccgagtcggccacttattataacaagttttcatttaagtaatgtcccttgttttaagtggtgcaaagatatgacttttttctttatctcaaaactttttcgcaaatttgtttaaaaaaaattcatggtaatttcattgatcggatacatgggaagtggcaaatcacacatttccaaaatattaagcgaaaaaatcggttttaaactgattgatctcgataaagagatttccagacgaaataaattaaccatccctgagatttttgaaaaaaagggagagatttactttagaaagctggaaagggaggcattggaagagatattggcttctgaagaaaatgtggttttaagccttggcggaggaactcctgtgtactataataatatggagatcatcaaccataattccaagagcgtctttttaagaacaggagtaggaacattggtggaaagactttcaaaacagaaagaaaaaagaccactcattgccaatatatctgataaagacttgccggaattcattgctaaacatttatttgaaagaaatcagttttacagcaaagcacaatttactgtgggaacagattccagggaaccagaagacattgttaacgaaataatagaaaagctctatctctagagcttttacttttatattaatcttcgttctcctcttcactgtctgtctctccaaaaaaatcatcccagtctgtaaaatcggagtcgatatcgtttccaacatattcatccatttctcttctgtcttttttggtaggtcttccctcccctttatttctgtaataatcctgtgacatcttacgaagtttcaacaattcgtattgttctttatcggtcacatcctgtatgtgaaggggtaccagcttggctcctatcctgctctttggaatttgaattacctttatcttataatcaatctgattcttacggattttaattgtatccccttcctttacctctttagatgactttacggcagacgttcctatagaaactctattctttttaatctcctctgctgcaatacttctcgtcttataaaaacgaatgctccataaaaatttatctattctcatatttttttatacttttgccgttatattatttgtaaagtaattaaagttttttgaaatgaaaaaaatatttttatatatccttgcaggatctttgtgtttttctgcttgtaagaaagatgattcgattgatacctatgtagagccggaagatgttgctacacaaaacacatacgatgatcaggccattaagaaattcatggatgagaattatctggatgcgcaaggtaatataaaagctttcagttctacagatactgcggatgacactgaaaagaagctgtctgaactaagtcctgtaacactaccttcaggaacaatctatattgtcagaagcggagctcagccaacgccagctgattctgcaaaaaccattaaggatgatgatattatcaaaatcatgggaagagcatattcttaccttgcagttaattctgacggaaacacttcatttacttcaaaaactgcatttttaaataccattgatggaacaggcgttccagttattgatcctacgtattattatgtaaagcaatcaatactggaagctggtacaactgatgcggcaaaacagcctggttattatcaaatatcaggtttcagggaagctttacagaaatttaaagcattcaataatcttttgaatgaaacgccttataacctacagggagtaatcattgttccttccagagctgcttttgcaagaaaccctcattatccgtatttaaacatgtcttacagaaacagatcttttgtattcaactttcagatttatggaagagctgacagacctgatggagaaaaacaaaagtaacaatagaataataatacaaaataaaaatagcccccaaaatgatcattttgggggctatttttattttgtatcaaagtgaattacgatcttgccttctgttttacatttcctaaaatatccgggaaataaaggtctgcaaggtggtcaaactcatctcctctcataaacatggtagcatctacttcttcataagaacttcttcccgcagcagcaataagttcgttgcaggtgtgaagggtatttttatggaagtgatatactctttctgccttatccgtcacatcaagtcctttaataagcattttatcctgtgttgcaactccagtaggacaattgtttgagttgcatctcaacgcctggatacatcctaaagagaacataaatcctctggcattgttacacatatctgctcccattgcaatggctctcagaatatcaagactggtaagaactttaccgctggcaatcactcttaatttacttcttacattatagttgttaagtgtcctgtttacaaatattaaagccggctctaacggcattcctactccgtcagaaaattccggtggtgctgctcctgttcctccttccgctccatctatggtgataaagtccggataaattttaagaacattcatttgtacacagatatcttcaaattctttggtatcaccgatacaaagtttaaaaccgaccggctttcctcctgaaagatctctcagctgctgtacaaacctcaacagtcctgcagcatcagagaaagcggtatgtgacggtggagaaataacggtcattcccggtgttacgtgacgaattgctgcaatttccggagtatttttcactcccggaagcactcctccatggcctggttttgctccctgtgataatttgatctcaatcattttcacattaggaagggttgaatatttggtaaacaactcagggttgaattttccttcatcatcacggcaaccaaaatacccagttcctatctgccagcacaaatctcctccctccagatgataaggcgagattcctccttctcctgtattatgataaaagttcccttttttagcacctctgttcaatgaaatctgtgctctgtcactcaatgccccgaaactcattgctgaaatattgaataaagaagcgtggtaaggttgtgtacattgctcaccgccaacccatactctgggaagttcttctgatggtgactttgcataaatagaatgcttgattccctcgtattttctgtggttcacttccagctgtgtcccgaaagctaccgtatcacttaaattttttgcacgtctgtatactgcagaacgctggtttcttggaaacggtttcccgtctgtttccctttcaataaaatattgctgcatttcgggtgaaatactttcgaaaaaatacctgaaatatcccaatacaggaaagttccttaaaatagcatgtttcgattggtaagcattgtaaacacccaatgcataaattgcggataacagcgtcggtatccagtaatgcgctctgatcagtattgctataatccatgtagcaactactaatacaattccccaagataaaaacttatctctcatgaatgtagtatttaaagtttaaaaataaatttagtagaatttttgcaaagagcctatgcttttgctaaaaaattttcgtaggaggattgcacagaaaccgtgccatctgacaggattttttctaaattcagaaattcgatttggtttactgatgcaggatcaaagtctttctggactctcacatagttttctgtgaagccaaacatttttccgtctttattttcgtgctcccaaagaacaggaagcgtttttccaagttgtgtctgataaaatgccatttttttcttttcagaaagaattctcagcattttattacgtttttttctttccgctactggaactactccgtccattgatgcggcttccgtattttctctttcagaataggtaaatacatgaagataggtaataggaagttcattcaggaaattataggtttccataaatctttcctctgtttctcccgggaatcctacaataacatctacaccgatagccgcatcaggcatcacctcgcggatcttgttcactctgtcgttgtaaagtttggtcaggtaacgacgcttcatttttttcaaaagatcatcgcttccggattgtaacggaatatgaaaatgcggaacaaagcttctgcttttagaaaccagttcaatgctttcatccttcaaaagattgggctcaatagaagatatacggattctttctatcccttctactttatccagctctgaaataagatcaaggaaagtgtgctcgtgtcttttatttccgaactcccctttaccgtagtcaccgatattcacacctgtaagaacaatttctttgatgtcttttgcggcgatttccgtggcattacggagaacattttcgatcgtatcagaacgtgaaattcctcttgctaacggaatggtacagtaagtacatttgtaatcacagccatcctgtactttcaggaaagctctggttctgtcaccaatagaataacttccgataaagaagtcggtttcttcaatttcacatgaatgaactattccttcgttttcagatttctccaaatcatcaaggtagcttagaatattgaatttttctttagctcccaaaacaagatcaacgccttcaatctgtgaaatttcttcaggtttcagctgtgcataacaaccaacgataaccaccaaaccttccggattggctttcattgctctttttacgtgaagtttacattcacggtcagcattttctgtcacagaacatgtattgataacatacacattcgctttttcatcaaaacttaccttctcataacctgcatctgttaattgacgggcaatagtagatgtttctgcaaagtttaatttgcagccaagtgtatgaaacgcggcagttctgtgaaaagtagacatttgttactcctgaattttatgggtgcaaagatagtaattttaataagaatgcaagattgattcaatctattgtttatattcgtccctcacttcaggactgttttgaaagcagacaggtgaagaattgttttgctgatctgtacttgaaaatctggttttcatttctgtattaaactgttgggaacggtttctggcaatagaaagtgtattccagtcttcattttttatcattttggcgatataaacaatctggccgatatggtatggataatgagccagctgacgaaaaactgcatccatcacagaatgcccttctcctctgatatatattgttgaataaagattctcatcatttattttgttaagagcattaaaaaaacaggcccaccctttttcccaatactcaacgacttcttttttagttgtaaaagagttgacaaactcatcatcacggttacgataagacttttctccgtcttcagtaaggaaattggtccatcttgaaagcatatttccggcaatatgtttcactattatagcaatagaattactttcttcattatactgccagaacatctgctcgtctgtgagctgatcaaaggttttatctccaagtgatttatagtactcaaaacgttttatgaacaggtctttcatgctttctattttgctacctaatttaaaaattttaaaatataaaaccacttcaatatgaagtggttttttctatctgttttattattattctctgtttttcaccagaacccagcctgtatatttaatggctgtattccttttatcattttcattccatgtgatagaataccagtaagttcctgtaggcactcttcttccgccctgggtaccatcccatttatagccatttgatctgtctgcctggaagatcttatttccataccggtcaaaaacattcatgatcaggttttgtttgttagccagtgcagaataatcgattacatcatttattccgtctgcattaggggtgatgacattgatcagattaggtacaacaattccgatttctatcggatcacagtcataagcatcttttacatacactttatgatcccctcttgaaaggttattgaaaacattggaatcctgccagatgatattatctattgaatatttataagccggagttcctccaattacagatactgtgatggtattattcgaaatatcaataccggaaacaaccggctgctctgaagggattacttttacagtctgtgtcgtgatacattctcctgttttaagtttcacccagtatactcctatccctgctttaatggtttgagtcgtagctcctgtactccattcatagcttttgaatccaggccctgcatccagagttgtctggtcctcggcacaaatcgtgacatctttaagtttatcagaatataccggcggaataacgactaaagtaattctggcaattgtgtaacatccctgggcattcgaaacccttacatatacaaacccattaggtgcaatataattattggcattcagtatctcattagtttgattaagagcatctgtcaatgaaggataatatttttttgtcggattggtctgccctgttactgaagcattgacaaggttgaaagaggctgtggatgggctggattcgatgaagcatgatcttaaggttgcctcattcactaccaccaccggataaaacttcagggtaatctgtgctacagcggtacaaccgaattcggatattaccttcacgtagataacgccttctgcagaaacaaatgccattggattggtaatttcattagtgccggcattgagatccgccatcgtgtgataatattttttggtgacattcgggttggcgataacgtctgccgtagtcaggtcaaataaagctgtccctccattattattgttacactcggtcaatgttacatttttaactgtgatagcaccattcttgaatttaaatgttcctacctgcttacatttattaagcggattagatgcatttgtaggatcggtataactgatactgtaataataaacagtggttgtattaacagtgattggggttgtaatcgggttattccctgttaaagcatcattctgacttacatgataacttaccccaaagttttgattcccgttaagaattcctgtggataatgtagaaaaatcaaataaagctgtaggagaacatattaccacttctctcgggtcagcaggattggctgccggaattccgggaggattaaatggctgagtctggatacttggatccgtaaatggtgaagccagtgttgcagttccgccccacgtgagagaaaacggagccgtggtagaactggtgctgcttacccagttatcaataaacaaataataagtctgtcccggcaaaacatcaagatacttgcaataaggggttagcgaacctcctgcagcacttaaaagtgtgcttgtcatattcaatcctgtagcaggaccaggcccgataaccgttgcagcattacaacgtattggcgaacctaagcttccacaggttacattaggaccaaaaattgcccagtcataatcggcatccggattgttcgggacgaggtcgaaagtgagtgttcctcctgtagcaatggtgattttataccatattgagttgtgctctccggtaaagtctatacagcttcccgagttgaccagttcttttatattaccatatcctgtgggactataagtgatatttgagtttccgcaaacggacagtgcagtggcacaatcagcctgggcatagaaagtatgagagaggcatagaagtatgaaaagtaaaatttttctcatagattatatgtttatggttatattagttatacatcacattgatagtcaatgcacaccaaatatacctatattttaattaaaaacaataaaaccataacaattttaaactattacaaattaaaaaacgaaataatttaaaattatttatattattttcaattaaaacacaaaataactaaacatataaaaacactcaatttacttgatacttgtaatatttccgcaaagattctcaaggtggaatattttatggaaagggcttttcacttccatcagatgttctttatcctgaatgaaagtatatcgtgaagcaatggaattcatatctgaaacaataaccagccagcattcatccacagaggtgtcatagtatggaaatttttcgttctttttttcaatgagttccagaatcttttccgaacagagttcatcaaacaggttcatgctgtattcatgagtgataaaaacattcctgcgatggaaagattttctcagactttttacacagccaacgggtttattttttttaatgcttttgtaaatactgataatgttttcctgctgtacttccaggctatcaaatttagttgccggatggaattctaaaaaataaacaccacgatatttcgtagtgtcttcctgttctaataatatttctgcctggcggaacattttattcaaagtactttccactttcttcatttccagatggttgatcacttcagtaagttctattccgatttttttgtcgtttaattttgcgataaagtccgggctctcgcaggtaaggttttcaaatttcacttcggggaagtggtgcatgaaagagttgagaagaaggatctcagatttctttctgtatttttcacggtcatgcagcggagattcgtctatggtacgatgatacttctctataggcttttttttcaaatgcctgttcaggtaatataaactcagattcttgatcagatcttcatcagagaatgtctttttcatgtgtgatttttttatttaattaaagaacacatgtggccattggctttcatcattaaaagtttttgataatcaaaaatttacattcttaaaggtaagtaaaaaaacaattcaatgcgtagtttttaaattaatttatctattaattaatgtaaagtttattttcattatttatacctttgcttttttaaacacaaacctacatttatggattttaggaatttcagaataccctacaatatcaatcctcaatattccaaaaaaactgtttatttctcaatggagtttgctcttgagcaggtactgaagatattttcgggaggacttggctttctggcaggatctcatatgagaagtgcttacaaccttaagcaggatcttataggcatcgggatcttatggaagtttggttattatgaccaggcaagaaatcacgatcagaccttacagcctgtgtggacaagaaagatgtacagctttcttgaagacaccggaatcaaattccaaattgaaatccatagtgctccggtttgggtaaaggtatggtatcttgacccagaaattttcaatacggcacctatgtttttcctttctacagacgttccggaaaatgatcatgtttccaaaacaatctgtcacaaattatatgatgccaatgaatccacaaagcttgcccaatatattttattaggaaaaggaggtgccaagttattggatgaaatgaatattgaaagagaggtttatcaccttaatgaagctcacggactgccagcagccttctatcttttaagaaaatataacggagatcttaataaagttaaggaaaaactcgttttcaccacccatactccggaagaagcaggtaacgaaaagcatagcttcaggttatgttatgacatgtcttatttttcaggatacagcatggaagaagtaaaaaagattgaaggatctgatgatgaccgtttcaatcattctctctgtgcattaagaatggcaagaatggccaatggggtttcccagttacatggtgtagtttcccgagctatgtggagtaagtatccgggcatttgtgaaataacttctattaccaatgcacaggaatttaaatattgggcagataagcctttatataacgcaaaggatgaaaatgatgccactgttttcgacttccgtaaaaagtatctgaagaaaaaacttttcagcattgtcgcagatcagacagggaatttattcaatcctaatgtctttaccattgtatgggccagaagatttgcaggttacaagcgtgcagaacttcttttacatgataaagaaagattctacagacttctgaataatccaaaatatccggtacagatcatctgggcaggaaagccctatccaatggattactctgctatttctactttcaatacgttggttgaagaaagtaaaaatcataaaaatatggctgttcttacgggctatgaactttctttaagcaaatctctgaaacaaggttctgatgtgtggcttaataatccaagagttccaagggaagcttcaggaacttcagggatgacggctgcaatgaacggttccgttaatttatccacagatgacggctggatcccggaatttgcaaagcatggagaaaactcttttgtagttcccaaagcagattatctgaatatgagtatttatgaacaggacaattatgatttaaacaaattatatgaaatccttgaaaacgaaatacttccaacgtattatgaccaacctgacgaatggagaaaaatccagcataatgcaatgaatgatgtgaaagaccatttcaacagcgacaggatggcagatgaatattacaaagtactttataatacaacgaaccagtgatatagcaaaaaggcaaaatagctaaagacaaggcgattaaaaacgaataacacatttgttattttgattttcaataaaaaaaccggaaaaatattccggtttttttattgagtttatttactttttttcttggaaggcactttaaggcctttttccctcgcttcagaaataccgatggctacggcttgttttctgcttgtcactttctttccggaagaagatttcagttttccttccttgaattcgtgcataacttttcctactttgtcctgagctttttctgaatatttagtcttgctcatgataagatttttttaagattttggcagggatacccctaattcataaacacaggcatgtttcaaatattttgaacgctctcttgatgttaccgactcaaaatgatcattcttgatcacaataatcgggtcttccgcattttcaatttcaaaattagctaaatacctttcatccggtggagactgctgttgttttgctttaattttctgcagttcatccgcgtattttctgaatcccgggtctgaggaatggataaatttatattcatcgcctgcatacacatagtaatgaagttttttctctatcaaacccgcttcatcattaatttcgggattatcattcccgtctctgaatactacttccaccaatgttcctccttttttacgggcgcattcttcagcgtctttaaaactggaaaaacctgtataaacgattcgatcattcattacataacggttcagtttctggttgtatgcattcgtttccataattattatttgatttgattatagttaatgttattcaatttttttgccaaaaagcgtaattgaaaagcttttttacacatttaataaaattattatctttgaaatccattaatgctagaaatgaaaaaactacttttaactcttactgtggcggcagtatttcaaaatgtatcagcgcaggaaatcactttagataaaatttattcaggatattaccgtggaaagggcattgcaggaatctcttccatgaaaaacggggaaaactatcttgttattgaaccatcaggaattgccaaatattcttacaaaacttcacaaaaagaaggaaatcttgtagacggaaagtttgaaagctatattttttctgatgatgaatctaaaattcttctacagctgggaagccagcctatttacagacattctttccttgggaaatttgatgttaaagatttaaaatccggaaaagtaatcagcttgaatgaaggaaaaccggttcaggaacctacattctcgcctgatgcaacgaaagtagcctttatttctgacaataatctgttctaccaggatcttggttcaggaaaaatcacacagattactactgatggtaaaaagaattcaatcctgaatggcttggcagactgggtgtatgaagaagaattcgggcacgcaagacaatacgaatggactaagaattctgatgcgatcgtatttgtaaagtctgatgaaagccaggttccggagatctatattccaatctacgggaaaaccctttacccgactgaaatgcgttataaatatccgaaagcaggcgagaaaaactccgtagtttcagcacagctgtaccgtcttgacaatggaaaaacaatgcagctgaacttaggttctttcaaaaattactatattccgaatgtcttccagacagcaaaaccggatgaaattgttttaattacttccgaaagaatccagaatgcttccgacattttaaaagtaaataccaaaacaggagctgttcagaagttgtttactgaaacggatgataaatggattgatacagatagtcctactctggaatttcttgaagacgattcattcctctgggcttctgaaagagacggaaaccgacacctttactggtatgacaaagatggcaagcttaaaaaacagatcaccaaaggaaactgggaggtaaccgattattatggattcaatccaaaatctaaagaaatttacgttcagacgactgaaaaaggaagtatcaataaggtcatttctaaagtaaatatcgaaaacggaaaaacccagctgatctccaatgcggaaggaaacaattctgctaatttcagcaagaactacaattatttcattgaaacttcttctaccgctgcaaggccatatacttatgttttaaaggatggtaatggaaagacagtgaaagaacttcagaacaacaacgaacagttacagaagttaaaggctgataattttgttgaaaaagaattcgtcacgatccccaatgctgttggagatcagatgaatgcctggatcatgaagcctaagaactttgatccgaataaaaagtatcccttatttatgttccagtattccggaccgggatctcagcaggtagcgaactcatgggataacggcaatgcgatgtggttcaatcatcttgtgcaaaaaggatatattgttgcttgtgtagacgggcgtggaacgggttacaaaggagcaaaatataagaaagtaacctatatgaacttaggaaaatatgagattgaagatcagattactgcagcgaagtggttcggaaaccagtcttatattgataaaagcagaatcggaatgttcggatggagcttcggtggatatatgaccagcctggctatgaccaaaggagcagatgttttcaagatgggaattgctgtagcaccggtaaccaactggagatattatgattcagtctacacagaaaggtttatgagaactcctcaggaaaatcctgatggatacgataaaaactctcctacagaatatgccaatctgttgaaaggaaaattcttattaatccacggaactgccgatgataacgttcacttccagaactctatggaattctctgaagcattaattcaaaataaaaaacagtttgattttatggcttatcctgataaaaaccacggaatttatggcggacagacaagaccacagctgtatcagaaaatgacggatttcattttgaataatttataagaatcatatttgtatctcaataaaagacctttcagaaattctgaaaggtcttttattgtttttttgttaaggatattttacggctttgtccagctctatgggggtgttatcttcttttatctgtttttgaatactttctgtcatttctttaaaacttatattgacagggttttcattaacatctccagttcttgttttaatatttctggcttttatttcagcaaatggatcactgtaataatcaatttgtaattttttataaacatcccaggttatttcttttcctttccgtaaatagaacatattatttttatcagattttttaattctgataagtttaaaatcaaaatctttctgttcatccgaaagctcaacaattaaaccaggaagtccataaaatatatatgggccttcttgtagcggacttgcaccatcaaaccaggccaaccatttgcgcccaccatattctgctacagctttctgacattccacgtcacctattttcattttatcagacagaatctgccattgtagcttgttattaatattaatgtaatataaatcataaaaagcaggatgtgtgacacttttataaactgtattacttattaagtttttgaatgaatatatactttcaaaagtaggtttacgactctgccaataaccatttttttgcatcagcgaatctgcttcgcgcgctttctctgacctgaaaacagattgcttccccagaacatccaaataataatattcatgtcttacattttttttatcagtccttaaagtgagctcatatataaaagtaatattctgtgcagtcagaatattcgctacaaataataaaataaaaagtaatggtttcatgaaggaattaataatattcagtattaaaaaatagagaaaagagatacaaaatgtatctctctaaaaacctgtaactgattaacatcattacatacaagcattatgtgactcaatcacctgcccattttgtaccgtataccaaaagccacattctaatccatattgcgcacatacatcaccagctcccggctgacaaaaatcttttaggcctccttggacaccttttaacttttctctcgaaatcttttttaattttttcataataaatgtttttaattatatgtcttgcgacatcccgaaactaaaaaacaaataccatatagaagcaaaataaacttgtatatctgttgtataacaatgatttacaacatgtacataatctgtacaaattaaattcagtaacataaattactctttacacttaaaattttatatttatttcattaatcacttaagcaagtattatttattttatcaattaaaattaaaaacctatttttgggaaatttgaaaattgattatatgaagactaaacatcctaaagggctgccttatctgttttttacagaaatgtgggagcgtttcgggtactacctgattcttggaatctttgttctgtatgttattgagcctacgggtatgaaaggcggacttggacttccggataaaacagctgatgacattttcggaacttatattgccttaacttatctgactccatttatcggaggattcctggcagacagggttttagggtatattaaatctatttatctcggtggctttttaatggctgcaggatatataggaatgggtatttttaaggatttacctttgttttatacctctcttgccttaattattatcggaaacggtttctttaagcccactatttcaacgttattaggaaatctttattctgaagaaccttataaagccaacaaagattccgggtataatattttctatatgggaatcaatatcggggcatttatctgtaacattattgcggctttcatgcgtaataaattcggttggggtgaagctttcatcactgccggagtaggaatgcttatcgggatggttatatttacagtaggaagaaagcattatatccacgcagcacagatgaagcctgtacaggaaggtgacaccaagctttcagaaattctgatcaaagtatttgttcctgcgatcattgccggagcaataggctggtttattcctgacaatatttttggaagtgacagtacggatgcctttatttttgcatgtatccctgttatttacttttatgcttctctttactttaaagctaaacctgatgaaaaagcctctatcggcgcgttactttccgtatttctgatcagtatgttcttctgggcggttttcaaacaaaacggtacagcgttaacaagatgggccaattattatacggacagaagtgttcctgcttcccttgaaaagcctttggaaggtatttatatggtagatgggaagagttatgaagacaaggaaactcctgtttatgataatcagttccgttcccagaaagatgataacggagagactaaaaaggaaatgggaaaagatgtttattttaaaaacatatcccctgaacagcgtgctgctcttgagaaaaatcctgaaaataaagtttatttatataatacggaattgttccagtccatcaatccgttctgggttattgctttgacaccggttgttgtaggattctgggcattacttagaagaaaaggaaaagaacctttaacccctactaaaattgttttagggctgtttatttcaggactttcctgtctggtgatggttttagcagtaatggcaggagacaatggtgctgtaaaggtatctccgttatggctggttgccagctatggagtaatcaccgttggtgagctctgtctttctccaatgggactttcttttgtttccaagctttctcctgcaagaattacggccctgatgatgggaggtttcttccttgctaactctgttggaaacaagctttcaggaattctggcaagcacatggtataattatgaaaacaagacaaattatttccttgtgaacttcgctttgttaatatttgctacacttttaggtctttctatgctgaaaagactgaacaaaattatgaaggaaaaaggacattaatccttgatattatacagattagcaagctgcggaatagttccgcagcttttttatttaaaaataaaattaaaaccttgccaaaaacccaaaataaactatatttgtcagtcttaacaaaaattaacaatagaaatggataatattgaagcattgagtccgaaaccggatgaatttgtagagaataagagttccaggcatcctaaaggattatgggttcttttcggaacagaaatgtgggagcgtttcaacttttatgggatgagagcacttttgacgctcttcatggtaaattccttattaataaaagaagctgatgcagcgatcatctatggtggatttctagctttatgttatttaacacctcttttaggaggatttattgctgataaatatatcggaaacagatatgctattatcattggtggatcattaatggctatcggccagttccttttattcatcagtgcctctacattctccgcagatatcggcagtgctaagcttatcatgtggctggcgttattcgtgatcatttttggtaacggattcttcaaaccgaatatttcctcaatggtaggaagcctttatccgaagcaggaaaaatctaaactggattctgcctttactattttctacatggggatcaacatcggtgcgtttctgggtcagttcatctgtccgtacgtaggagacgtaaaagatgctgcaacaggtgtaagagatatctttgctttcaaatggggattcctggcagcttctattgcgatggttatcggaacggtaacattctttatccttaaaaacaaatatgtagtaactccggaaggaagacctatcggtggattaccaaaaaataatacaagtgctgactttgaggaaggagaaacacagactgctaaattctctggtcaggctttaggaattacaggaggaatattcgttattttattctttgtattcagataccttcttgtaggtgagtttggattcaattctgtagaaatggggcaactgatcaaaggaatcatttatccatttatctactcagccggtatttcacttgctttcttaattatgtcttctgctgaaaataaggttgaaagacagagaatctgggtaatctatatcgtatcattctttattattttcttctgggctgcttttgaacaggcaggatcttcattaacatttatcgcggataaccaaactgacagaaacattttcggatggaatatgccgccttcaatggttcagatattcaacggaatcttcgttgttattctggcagttcctttcagtttaatctgggataaattaagagccaaaggaaaagagccggtatctccgttcaaacaagcgatgggattggcattgatcgcgctttcttatttcatcattgcacataacgtaaaagaccttggaaactcaggtttattggccatcaaatggttaatgttgctatatttcatccagacatgtggtgagctttgtctttctccgattggtttatcattggttggtaaactggctccgaaaagatttgcttcattactgtacggtgttttctttatttccaacgctgctggttatgcattggcaggttccttaggagcacttatccctgcaacaggtgataaattcaagaaagctgaagaaatgggtattaacctacaggatgttttagataaaaaagtaacccttacggcagatcaggctgcagctttcgataaagctcagttaccattacataaccctacttttgtaggattcgaaatccataacttatttgaattctttatggtattcgtagtactttgtggtattgctgctgtaatcttaggtttaatttcacctatcttaaagaaaatgatgcacggtgtaaactaattgtatcaacaaaatatcataaaacctctgccaagtcagaggttttttttattttcgtatgatggaaatttccgaagattctttattccaatccgtaaaggaaatcattagacaatcgcgcgaaaaagtgtttcgtatagcgacttctacgctactgctcacttactggcaaattgtaaaattgattgttgaaaatgaacaacaaggaaaagaacgtgcagaatacggaaagtatacactgaaaaaactttctcaaaagcttaccttggaatttagaaaagggtttgattatacgaacttttctaatatgcgaaagttttacacagcgtttccaattgttgacacattgtctcaacaattgagctggtcccattacagatttttcccactcaaaatgataaaaacaatttatttgccagcaaatacctgctgtacctcccaaacgaagaaaaattaaaacaaattattgaccaggacggaatccgttttgaactggatcagaaagataaaaaccctaattagaacttaatcatatatcattatgagcttaactttagatgaaatacaaaatttcaaaggaaaatatcccagacagatctggagcctttttttctctgaaatgtgggaacgcttctgtttctacggaatgcgtggaatgctggtcttctttatgatctctcagcttaatttccatgaaaaagaagctaaccttcaatatggtgccacacaggcattcgtatatgcctttacttttgtaggcggcctttttgccgataaaattttaggattccgaaaatccttgttctggggaggtctcctgatgatcgtgggaagtttaatcctggctacagatccccataaattctttttcttaggaatagcattcaccgtagttgggacaggtttcttcaaaccaaacatttcatctatggttggacagctttacaaacctaatgattctagagcagatgccggattttcgcttttttatgcaggtattaaccttggagctttactaggtggttatttatgtattgccattggtaaaggagaattcttaagtaatgttattgcggaagaaatgagatggcatattgcttttggattggcttcaatcgtaatggtagtaagtttaataaattttgtattcacacaaagaacattaggtagtataggattacagccgggacaccctttagcagaagtaaaaacagctccgatcccaaaatggaaagaatatggagtatacattttatcattgatttttgtccctatcattatgaccatggtagcgaaaacagaatatacggattattttatgtggacaatcgggccattaactttaatctatttattctatgaaatgtcaaaagtaaacgcctctgaacgtaaaaagctttgggccgctttggttttcattattttctccattatattctggggtatttacgaacaaagtggaggttctttaagtatttttgcggctaaaaacctgaacaaagatcttttcggattagatcctaatggtgttaataactcagggggagccttctttattattttccttgctccacttgtaggacttctctggatctggctgaacaaaagaaaaattgaacccaatacgattatcaaattcggattaggatttattttcctgggattaggatattatgttttatttgccaccagactatttgcagatcttcaggggattacttcattgaacttcttcaccctagcattattaatcattacccttggagaattatgcctctctcctatcgggttatctatcatgacaaagctttctaccaagaatcttcagggaatgatgatgggaatgtggttccttgcttcagcgtatggacagtatgttgcagggattatcggagccagccttgcgacatcaaaaggaggttccagcaactatgatgctttgatcacttatactgatggatataaacaattgggattgtacgcggtaattgccggagtggtactaattttgatatctccgtacgtgaaaaaattaatgcaggatgtaaaatagaaaataagtaattatgcttatttttacctaaatatcacaatatgaagaaaattttaagcatagttctcttacttctattaaattttcactttgctcaggtaaagtggatgaccattgaggaagctttaaaagctcaaaaggaaaatcctaaaaagatacttattgatttttatgcagactggtgtggtccctgcaagattatggataaaaaaacatatgggcattcagtaattgcacagaatctgaatgagaattattatcccgtaaagttcaatgcagaagaaaaaaagagtattgagatttttggaagaacattttccaacccaaatactgaacataagaaaggaagaaattctctgcatgagtttacacagtatatgaatgtcggcgctgttccaagcacagtatttctggacgaacatggtgatcctattaccattcttcagggggaattgtctgccaaagaactggaaccttacctggaactaatctcaaaagatttattcaaaaagattaagaccagggaacaatgggaggactaccagaaaaagttcaaatccaaaatcaaagagtaattacattttcaggcttcaattactttatataaactaagactttcaattttttttggaagtcttttttattttaccgaaattcggacctttgttttttcataccatattcggttcccgaatcccagataagaaatgactttagaaacttccatagaatatgtaaaaggaataggtccggaaagagccaaactcattaaaaacgtgttgggactgtctactgtagaagatatgctgaacttctatccgatccgctatctggataagagtaaaatttataaaatatcccagcttcaggaagaaagcagtcaggaaatacaactgaaaggaaaaatcacacaggtgcaggaaatccagacgggcaaaaccaagagattatctgctaaattcaatgatgataccggcagtatggatcttgtgtggtttcagtattcaaaatggctgaaagagcagctgcctgtcaataaagaggtttatattttcggaaagatcaatgttttcaaccgccagttttctatgccgcatcctgaaatagaggctgaagaaaaaaaagaaggcgatacccgtttgaaaccgatatatccgagttctgaaaaactgacaaaaagaggattaaatcaaagattttttcagaatgctctaagaaacatctgtaaagaaattccagggcttatcgaagagaattttccggattacctgatgaaaacctttaagttcatgtcaagacagcatgcttttctgaatattcattttccaaaggatatggagcattttgacaaggctgattaccggttgaaatttgaagaatcatttttctttcagctaggatatggcttaaagaagcttcatcataaaacccagtctcatggtaatccttttccaataattggtgatcattttaataacttttatgaaaatcaccttccctttgaccttaccaatgcccagaaaagggttttaaaggaaatccgtatggacatgaaaaggccaattcaaatgaacaggcttttacagggagatgttggatcaggaaaaacaatggtggcacttcttaccatgcttattgcgatggacaacgggtttcagagctgcctgatggctccaacggaaattcttgcccagcagcactataacggtattaaggaactgttggaaaaaacaggaattaatatccgtcttctgacaggctcaaccaaagccgcagaaagaagaataatccatgaagaactggaaaacggaacgctttctattttggttggaacgcatgctgttttagaagataaggttaaatttaaaaatctgggattggccattattgatgaacagcatagatttggagttgctcaacgcgccaagttatgggctaaaaataaaattcctccgcatattctggtaatgactgccactcctatccccagaactctggccatgagtttttattctgatcttgatgtttccgtgattgatgaaatgcctgtgggaagaaaacctattattaccgctcatcgccgggaaaaagacaggttgtatgtctataatttctgtaaagatgaaattaaaaaggggcgccaggtttattttgtatatccgcttattgaagaatctgagacattggattataaaaacctgatggaaggtctggaacacgttatggattatttctcagaatataatgtgactatgcttcacggaaaaatgaaaccggatgaaaaggatgctgcaatggcttattttgcatcaggaaaagccgaaattatggttgcaacaacagtaattgaagtaggggtaaatgttcccaatgcttctgtgatggtaattgaaagctctgaaagattcgggttgtcacagcttcatcagctgagaggacgcgtgggaagaggcgccgaacagagttactgtattctaatgacatctgataaattatctaaggaaagcagaacccgtatcaggacaatgactgaaaccaatgatggttttaaaatttctgaggtagatatgcagcttcgtggtccgggagatatcctgggtacgcagcaaagtggtgtagtggattttaaaagattagaccttattaatgattcagcgatcattaaaacaacaaaaaatacggtggaaaaaatactggaagcggatcctatgctgtccagacctgataatcagatcatcaaaaattattacatcaggtattacaaaggaaaaaataagtggagtaaaatatcataaaaaaaccgcagaaaaagatttcctgcggcccccttataaaactgttatttagaagaaattactttttggtctctgtaaaatttattttaatagtttagacttaatattttgtgatttggtgtgaaaatatttatataataatatgatgtagtcaaagccacaactattaaaataaattataaaaaacaaaatgaattattttttccaacttgcttattataaaaactaactgtgtttcgatggagatgagggaatgaaacgaataaaaatatctccaactacttattgagttttcatgattgtaccgttttgtttaaagatcttctgtgctttaaaattggaaaattaatataattcattttgttactaacatcgtgatttatataattttgttatagaaacaattacttttcattcatctgtatcttccactttataatgaaatttgtgtctgagtttacttttacaaatgtcagtatattaattcagatcctttttatattattttaatgattagttataaaattttcacctatttgtgaatagtatgcattaaatatgattttcaatcagttcacaataaattaacaaatcctttatccatcatactttcaggataaaattatctttattcaatcctgaagtatgatactgccaattgatcgttataacttctgtaagcacctttttcaacttatcaaaagactctggttttttcataaaaatattggcaccttttacaaaaatatcttctatttcattttcaggaatcggttcagaaaaaatcgctgtcaccatattgctgaattttgaatttgaatcaatttcttccagacataccatgctttcttttccgggaatcatatagttaatgaaaacaagttcaggtactaccgcatcatgattattcagatactccatcaggtttttaccgttattgaaacattgaacttttatagagattttcagctctttcaaaatatttttaaaaaaaatcaaggtgttttcatcgctatctgccactattacgttcaggaattctttattcatactgcattttagggtttattaccgtgctttgtattcttcttcgtctgccaataatcttttgaaactgagatggagtgattcccgttgtatttttaaactgggtacttaaatgcgccacactggaataattcagtttatgggcaatttctgtaaggctctgcttgtttcttatgattagcgcttttgcatgctcaatcttttgcagaataataaaattctcgatagaggtataggcaacttctgaaaacaggttggaaagatatccgtagctatggttcagtttctcagaaatatagattgatgcctttacgggaataatttcatcagagaaaacaagttccacaatagcatcttttattttctgtacaagagcggttttctggctttctatgatttcaatcccataatcctcaaggtttttcttaaaaagattgtgctgttcctgggttaggggctcatagaattccacctcgccaaagttcagcaacctgtacttcagcccgtgttctttaagtttttcgtccaatacctttttgcagagggcattgaaatcaaatttaacatacattttcatcctagtatatataaagccaattttatttagtaaatataacaaattatttcatttaaaagtgaaataggtgtatatttttacattttgctttatatacgaaaaaactcctgtattatttaatacaggaatttaaacactaaggatgaaaaaaatatactgataaaaagctgaatcagctcaaaaccaagcatatgaatgtattgttaaaagtgatttggttctgaaacaaagatgaatcaaaaaaagaactcacctgttatagaattacaggataaagttacaaaattttaagtcaatcaattgtgaattagaaattccatcagataatcatccattacaaaaccgtttccgatatcaaaaactccctcgtcgtaaactttgtagccctgagattcatagaagtttctggcagaattgtatttattgacattcaggattattctgttgtttccattctcagaaactttctcattcagaaactgaagcgcttcttttccaaatcctttccccttactttcgggaaccagataaatacggtgtagtttggttgtattttcctcataattgtgctcatatccgataaaaccttcatagctgtcattatgttcatcccgaataagataataatgataatccgggttttgaagatgactcagaatctcagattcagagtacatttcggagagcataaactccatttgttctttcgaaagaatgtctgcatatgcattttcccatgacctttgtgcaagatcctgaattaaagggatatctgatgctgttgcctgtattaatttcatgattggatatattatgatgattaaaaaaagtgaaaagcctaaacttttcaccctttatatgttgttcaatgatgactgacgaattttaagaaatgctcaaaattcattttcatcattaaatgttagccatttcagccttaatttttgcatgaagcccttctgatgcttttaccaaaggaagtctcagataatttttaatgattcctttttcagccagtattaccttaataccgcaagggtttccttcagcaaaaatcaaacgggtaatatctacaagcttattgtggatttcataagcctcttttactttaccttcaaaagccagctgtaccatcgttgagaattctttaggatatgcctgtgcaattacagaaatcactccgtctccacctgctaatgttacaggcaaggtatactcatcatctccggatactaaagaaaatccttcaggtttctttctgagaatatcaaaatactgtaagatattcggtgccgcttccttaatcaaaaataaattagggaattcttttgcaaggcgaattgttgtatctgcttctatattctgtcctgttcttgaaggaacattataaatgataatattttttcccgttgatgctaaagctttataatgttgataaagcccctcctgattaggtttattataatatggagatactgaaagtactgcttcaaatgcagaaagatctgcttcttcaatctgtttcttgacctcaagagtattgttgccgccaattcctaaaaccaaaggaagacgtttattattcaccttaatgatatgctcaattacctgtttcttctcctctgcagaaagcgttgcggcttctgccgtagttcccaatactactaaataattggttccgttttcaatattgtattcaaccagttttgttaaactgtcgaagtcaacggataaatcttcattaaagggtgttaccaatgcaacacctactccttttaaaatgctcatctgttagaattatttttgccaaatttaatcatttacagtaagaatttgtaataaataataatgttttattatacatatagttatatttgcatatactaaaagattatgaaaaataaattcttgttactaggaattgccctggcgtcccttactgcatgcaaaacggcctctgcgccgcagcttgtgaatgtaaagacccagaaaaatatttctattaataatgagctaaaaaatgatgaggagtttgtaaaatttattgagccctacaagcaaaaactggataaagaaatgaaccagaagatctcccacaccaatgtagatcttaccaagcagggtgataacagcaatctgggaaatcttttagcagactatacgtttgaaggaggtaatgaatggcttaaaactcatcttaagcaaaacgtagacgctgcactgatcaatatcggaggaatccgcaccacaatcggaaagggagatattttactgaaaaatgtatttgaagtaatgccttttgaaaatgaggttgtgattgtaaaaatgaaaggtgcagatttacagggcctttttgagtattatgcaaaaacgcaggtcaacaatcccgtttctcacttatatattgaaacaaagaacggacaggttatcaaatcgttaatcaacggaaaagtagcagatccggctaaagattattatattgccacttcagattatcttgcgctgggaggagacaatatgaaattctttgccagaggagaatccattgcaacaggaattaaaatgagagatttatttattgattattttaaaaagtctccagaagttgtagccaattcagatgttcgtttaaattttatcgggaagaaataatggatagaaaaagttttttaaaagcaataggtggcggatctttagcaatggctttagctcccaatataatgatggcggaagaattaaaaattcttgatgtaaaatccgcaaataaactgactattcttcacaccaatgaccagcatagcagaatagagccttttgactcgagctataccaaaaaccctaatcagggaggcttcgccagaagagcgagcttaattcagcaaatcagaaatcaggaaagcaatgtgcttcttctggattcaggagatattttccagggaactccttattttaatttcttcggaggagaactggagttcaaattaatgtccatgatgaaatatgatgcctctactatgggaaatcatgatttcgacaatggtctggacggatttttaaaagtccttccaaatgcgaagttttcttttatctgttccaattatgattttaagaatactgttcttgatgggaaaacttcaccttatcagatattcaacaagaacggaatcaaagttggaattttcggagtaggaatccagctggatggactggtaggtaaaaaacaatatggagaaaccgtttactccaatcctattgatgtagcccagcattattcaaatttcctgaaaaaagagcagaaatgtgatctggtaatttgtctttcacacatcggctacgattacagggacgaaccggataaaataagtgataaaattttagcggctaacacagaaaatattgatattatcctgggaggccatacgcatacattcttaccggaacctcaatcctttaccaacagacagggcaaaaatgtccttgtcaaccaggtgggatgggcaggtctccttttaggaagaatagatttttattttgatacaaacaaaaacgtacagcatatttcctggaacaatcaggtaatagatagcagcataaccgcataatatgaaaaaactctctataatttctcttggtattttagcatccctgcagctgacaaaagctcaggttatttcatccaaaaagtgggcagatctgttttcctacaacaagattctggcaatgaaagaagacaatggaaaaatcattgcagccacagaaaacggaatattctattatacaatgtcaacaggagaaattacgaagttgtccaaagccaatggtctgcacaatatcgggattacagcttttgattataatccacagactaaaacaggtcttatcggttatgaaaacggatctatggatgttattaccccacaggaaattaaatatattgttgatattcctattgctacgggttataacggaaataaaaagatcaaccacatttctataaccggagatcaggctgtcatttctgttggatacggagtttccatatttaacctgcaaaataaggaatttggcgattctgcatttttcctaactggtggggtttatcaggccagtaatgaagctacgatattcgggaataaagtatattccgtaaccgatacaggattgaaaagccatcaaatgaacactactttcccggtatactctacctggacaaccgaaatacccggagcttttaaacatatagattcggaatcagagctggcttactcaactgcaacagcggcatatgtttacaacaatggtgccccgatacaactcccgacaactttcgagaatatacgtgatgttgtgataaactccaataatgttgtggttacagataacagggtttatacttatggtatcaacggagtggcacaaaatgcagtaagccttggtgaagaatgcaatactgccataacagctggtggaaaaatcttaggcggaacagtattatcagggataaaggatgaaagtaacaatacttttaaaccttccggcccttattttaactatgcctataacattaatcttttcgataataatcagcttctgatctcttccggcgccagaacaaataattataatcacccatctattccggcgcaaaagccaagtcccggtttttattactttaatggtaccgaatggatctacccttctttctttcttaaaaatcctccaagcaatgtcaatgtcctggatgctattataagcccttataacaataatgaggtactgttcaccaattatacaatgtttgataatggtgtctacagaatgaaatataatgctacaagcaaagattttgaactggtaaaatattataatctgggggcccagccttattacagacgccctgtaggttttgctgttgacccgcagaataacctgtttgtatccttcggatttaatgatggaaacccgtctatgggaatttatgataaagcgagcgatgacttccttatcaagaaaataatccttgcgagcgatggaattcaaaagactgtttattatgaaaatatgctgtggactcctctgccaagatccaataatttctgggtctatgattataaaaatgcattgaacctttccgatgatacggactatatcctggacagctctaatggatttaatagttcgggaggaatattatcagtagcatttgataagtccggtgatgcctggattggtacagacggaggtctaaggattatgccaaacgctgcatcagaaataaaaagtgcccagcctaaagtagaacctatagttatagagcaaaatggtttgggtgaagaacttttcagagaatcggcaattcttcagattgcagtggatgcaggtgattataagtgggtatctgttgacggtggtggtgtttactacctgtcttcggacggtcagagaaccataaagcattttacaaaggaaaattcacctcttcctacaaacagtgttacggatataaaagttgataaaaaaacaggaaaggtatattttgtaacgtataatggtattgtaacctatcagggtgatgtagcagacgtcacgtctaattttggtgatgttgtggtatatcctaatcctgttgtgtattccaatttcaaaggtaaagttaccattaaaggtcttgcagaaaaaaccaatataagaatcgtagatgcagcaggaaatgtagtacattctgccgtagcacgaggaggttattatgaatgggatcttaataatcagaaaggaacaagagtagcttcagggatttattttgtcctgatgaccaatgaagacggatctgacaaagctaccgccaaaataggagtagttaattaatgaattcacaaaacggatttttactttcatttataaaatatggagaaaacgatgctgtactgcattgttttacagaagaagaaggttttcaaagctatttcctaaaaggaatttatgctaaaaggaataagaaaaaagctctgcttcagccgctgagccagctcaatttttctgtcaatccatcacggggtaacggaatcccgtctgtttcaaagtttgaactggtaaaaaacaatgacatttatacagatataaaggtcaatactgtcattttctttatttcggactttctgagccatattcttaaatatgagaataaaaatattccgatctattccggtatagatgattttgtaagtgaactgaccaacaaaaattatcaggcacacctgctttttttactggctattttaaaaatacagggagttgctccattattaagcgaaggaaaatttttagatcccgaaacgggaactttttctccgggaatatgccatcagctattcaatgaggaaatttctacactatggaaagaagcgctttgtgcagaaaaattttatgcaacaaaaatccattcttcattaaggaaagatttcctggacagtcttttagtgtattatcactatcatatcacggatttcaaaactcccgcctcactggaaattatccagcagatatttgagtagctaatcaacagatctactgtttactttcttttgttttttcagtatcctcaggcatttcagtttccgattctgcaattacctttttggaaaatctcggctgcagaatcttggcaataagccccgtccatcctgtctgatgggaagctcctactccacggccgttatctccatgaaaatattcatagaaaaggatataatctttaaagtcaggatcggtctgaaatctttcatactgaccgtgaaccggccttttcccgttttcatcttttaaaaatattttcgcaagcctcttgtttaaggcatctgcaatctgatcaaggtttgaataattaccgcttccggtaggatattcgactaaaaaatcaggactgtaatagaagaaaaaacgctgaaggctatcgataatcaggaaattgattggaaaccacacagggccccgccaattgctgtttccaccaaacaacccgctatcactttctgcaggagtatattttacggtataatccgtttcattcagagttaatgtgtagggattattttcgtattcttttgataaagcccttactccataatgactcaaaaattcatttgggttcagcatccggtttaaaagtcttttcagacggtggccacgaagtaatgataaaaggtgtttggaatcctggcctttgacctcccatcttgagaccagcgctgccagttcaggcttattatccagtacccatttcattcttttcttgaaattgggaaggttttcaatcatttcatcatcgatgacctcaacggcaaacatcgggatcagcccgacgatagttcttaatttcagatacatatgagttccgtcactggaagtaattgcatcatagaaaaattcatcctgctcatcccaaagactgaaattctcatctcccatattatccagtgaatgggcaatcgacaggaaatgttcaaagaatttcattgccatttcctcgtatactttattgtaaagagcaagttcaagggcaattctcatcatattcagagcaaacatagccatccagcttgttccatctgactgttccagctgttctccattgggcaaaacagaatttctgtcaaaaacaccgatattatcaagtcccaggaagcctccttcaaaaatattattcccattaaagtcttttttgttaacccaccaggtaaaattcatcaacagtttctggaaagcactttccagaaattccaggtcaggcttatcttttaaatattcatcaattttaaataccctgaagaccgcccaggcgtgtacaggaggattcacatcactaaggtcccattcgtaagcaggaagctgcccgttgggatgcatataccattcaaacaggaaaagtttcagctgatgtttggcaaaatccggatctatcagtgaaaagctgatggtatgaaatgcaagatcccatgttgcataccaaggatattcccatttgtccggcatggaaataatatgctcgttgttaagatgcttccagtcgaagtttcttattgtttcccgggactttggcggcggcatttcggcagggtcacctttcagccatttttccacgttgtaatggtaaaacattttattccacaacattcccgcaaaagcctgtctttgcaccaatttttcatcatcagaagaaattcctttctgaatttccgcgtaaaattcatccgcttcattctgcctttgctgaaaaagtatatcaaaatctttaaatggatcccgtaaatctttgtcggacagtctgaattcaaatattttagtttctctggctttaaaatcttcatcaataaaaaaagaagccttggtacctgcattttgcggatttaccgactgggaatttcccgtcatcacaaaattattgattccgtctttgcaatattttgattcattagagcattgataaagcttttcattgttggtttcattgttacagaacagggtttttaaagactgtcttgcatacacatttttaatatcaatatcctgatgatttactgtaatatggtcagcatcttcagcagacagttgaggcttatagccatcatacccccagttccaggtatttctgaaccagactgtcggtaaaatcacaagagaagcttctttctcagatttattgacaactgttaacctgaccagaatatcgtgctggctttcctttgcatattcaataaagatgtcaaaatattcattagtatcaaaaattcctgtatcaatcaattcatattccggatcgtcttttcccctctccgcattgatttttaccagatcttcataaggaaaagcattctgaggatacttatacagcatcttcatgtaagaatgcgtaggtgtggaatccaggtaatagaaatattcttttacatcttcaccgtgatttccctgtccgttggtcagcccaaagaaccgttctttgatcattttatcctttttattccagaatcccacagaaaataccagcttctgaagatcatcacagatgccacatatcccttcttcgccccaacgataggttttggcttctgctgtttcatgattggtataattccaggcgtctccgttttcactgtagtcttcacggacaagaccccattcccggttacttacataaggtccccattttttccaagaaatatctgagattctctgctgttctgacatatgtgtagttatgagtaatgagtaataagtaataagtaatatttagtattgtttaaagcaatgagagcaacctcaaaacattaaactttgaactgttaaatcttgaactgcactatcctcctgtagaaaaactttcaaacgtagtcattccgccatctacaaaaatgcttgttcccgtgatataatcggcaagatcactggcaaggaaagcagctaaattcccgatatcctgcggctgtccgattcggttataaggaataagggtaagaagtgaattaagcgcttccggagtatcccaggcattcttgttaatcggagtctgaatggccccgggacaaatagaattaacacggattttatctgcaccatattcctgggcaagagtctgcatcagcattcttacagcacctttactggatgcgtaattggcatgtcctgcccatggaatgatttcatgtactgaactgatgtggataatctttccgcaagcgatagaacgggatgtatctattccgcgtcttaaaaattctttaatggcttctcttgcacatagaaactggcctgtcaggtttacacctatgacagcgttccactgatccatcgtcatttcggtaaattttgcatccttttggattccggcattattgatcaggatatctacggtttgatattcagcgactacatcccggaacattttcactacctgatcttcctttgaaacatcacattgataggtcatgccttttccgccggcatctgttatttctttcaaaacagctttggcttcctctgcagatctttctgaagaatggttgacaatgaccgttgctcctgccgaagctaatgattttgctattccggaaccgattccgctggaagctcctgtaaccaaagccacctgatttcgaagtgatatttccatgttttgtaatttgatgttactcaaagttatggaaagatatcagcagatgaaaaattatgattttaaaattttattaaagtttcttgtacatgagatattgaggcccgcttctaccaattctggttttaccatcgtaaatgtatcctaccttaagataaatatgataagctgaatcgtttttctggttgacggccagtacaatttcatcacagcttttaaaacgatcttttacaaaatcatcggctttcaacatggctactttcccgattccttttccctgcatttggggattaatggataaggaacgtaataaagctgagttttcattatcagtaagctcaaatttatcttttccaaaatcaagtacaaagaaacctgcaggctgatcgttgtaaaatatagtcacgggaaatgctttgttatcatcccgctcactgatgctttgtaaggcttgctgaacagtcgctgtaaaacgcatctgattttcatccaaagcataactcaacgcagaaagatcctctggtttaaagaattctaattgtatcatattagtgatggtaaatatcttcatacattacgcctgcacggatttccacaggaagtttattttcctccgggacaacaggacaattgtaatcgtaagcattataagcacagaaaggatgataagatttattaaaatcaagaacaatcgtgtctcctttcggaattttcagatccatatattttcctcctccgtaggtctctttttcattggtagcgtcgcggaaaggaaggaagagatagtctttatatttttcctgtttaatcaaagcaagactttggtatagcgtaactgtgtaagatttaccatctaaggtaaatgttgctttgccatactcctgataggtctttgttttccctgaggaagtaggaagctcaaagggttttgtatcttttgacttaacaaattttgcagttatcctgtatttggcattaaagggaaaaaatggatgtcctttgaaatttttaaaattatcacctcttagaggggtctcttttggattaaaatattcatcattaagttccttctgaaatttctgtacctctttctcttcctttgaaatcgttttctgagaaaaagcccataacggaagaagtaaaaagagtactatatattttttcataagtataaattataagtaaagctatgaattttcataaacaacaaaaagttaaaattctgataaaaagtataatctgttgtaaatacaacaagcttccgctgatctagcatgctttttgaaaaacaaagctcatggacagaaaaaaattcatcaggacaagtgctttggcaatatcataattttatcttctaaaagttaacattcatccaattttctgcttttaaaataaatcaatattgaattttgttttctaaaacaaaatttaaaataaacagaagaaaaacaattaacaaaacaaaattccaactaaattgctaatattagtaaaacaactgctatttctttctttaatagactaaaacaattttcgctatatttcctattgataaaataaatagaaaccagaactaaaaccttctgttgttaattctacttattatattttaaaggcaccaagtcctttttatgtatactttatagattttatttaacgattgtcataattttgtatagtgtttttgtttaagggggtttttactccaatcttcccaaataccagtatatggattgtacccacattttaatggcttagacgtatctaaactatctttatttatatgtgttttttcagtaaaagccctgcaatcagtacagatatacctgaattcacagtctttacatatttctatctgatctttagtaatgttccagtatttcttaaaccctggatttttgataacattttctaagctggtgtcatgaatgtttccaaaattttcgggcattaaaggacagttttttatattaccatcattgtcaattccaatttttttatgtaaacaagagttatgattgaaggcttccagaacttttgtgatattggtgttaaagtattttatatcaatttttccacaggaagatatatctatgttgtcttttataaagtttaaaataaaccggtactcatctttcaccctgaacggaacttttttacaattgtaaaaggtaagatgatataccctaatagtttttacattcagttcttcgatgaaatttctgtctatattattgtgataaggagaaaaaatttcaattcctgataaaacagaatcggcgaacgtttgttcaattcggataatatcttcaacagtaaaataatttttactgtgaatcactaaatattttattcctaagttttctacagattgtttcaatttttccaaaatagaaatatcactgagttcaataaataaatcattgataaatgatggattgttatactcgtatgaaataggtggaaagcttttatcccaatcattttccgtaataaagccgtattctttatctaatagtaaattcaaatattggctaaaaatttctttagattcatcatcataaagagttgagatttcttctatagactttacttttaattcttcgattatatcataaaactccaaaggatatacttcagatgtttctctttgcagatcagaaattagtattctttgtgcacctcttgtaattagagtattgctgaataaattgaaatacctcatagtaatctagtaagagctttaaacggcttttcccggaaataaaaattagatctatattttttagattctaaaaaatatactgtattactgttacgttttacatttgttctacttccaaatttcgttatatttttaaatgttaaagggagtttatgcttttccccaaatgtgtttatcatagatattctgctatttctttttctaatgaataattacatattttagataaatacccaaattgccctattgggttcacttccaaaaaatagtatttctctccgcttttcataaaatcaagagaaccacagttaagatcaagaagctgcatcaactgatgaactttttcttcaatctcttttggtaggttatatcttacatttttattacgcttttcataattataatttctaaaatcgactttagtctgctcatcattttgtgaaaagatagctattgaccaacatttaccatttaaataaaatgttcttatttcaaaatccttttcaattttttcctgaaaaaaagtgggaaagaagtcttcattttcaaattcttcaactacagatgtgaacatcattccattcgaatttttataaaaagattcaagcattgcgtttcctgcaatagtttttacaatcgtttctcctaaaataacatcatcagtattttcagccagataataggacggaacatctaaaccgactttttctgcttcttctaatactaatagtttatttactaagctattactctctttattgatatgttttatagtttcaagttttttctttacataatcttccagccagtgctgagtttcgttcatgttgatattaatggaattatttttatatcgaatacgcttaaaattcaatcctccccttctataccaaacactgcttatatcatctaaaaaaaatcggttagaagaactttctaaaaaaaatctttttttgatgattttaatttcaaatatttcatcctcatgtatacgtataaattttttctccagtactatcagccattttattacatccgtagtagaaatatcattattatcagaaattattaatatcattttttacttgaattattctttaaaaattcttttgttatttttcttctaactttgaagctttgtagcccaataagccttctattacgattgatatttgctgaatcctttatgatttcttcatcagtacttttcacgccatatacgggccttaaatgattaatctgaacatatctttctaccatttctacataatctcttggtgggagatctccggatcttacataatctaccaacttcgttttgaaatattcataatcttctatttgagacatatgatttaaataaactaacattggcattaaaacaccatcatccgtttcaagtccaattttttgcaaagacggataaccataattattaagagtccattttagtagttcagcatttttcttgaaattttttaatgattgttgtcctgttatagaatctttagcctgatccctgataaaagctattctaaaagaatcaataagctgtttgtttagagactttttccattctgtaactttctgctcaacagttatactatcgattccatactttttatatagcttaaaaaaatctttgtcctctcgtttgaacttccagtatggagcaactagcgggataagtttataaagacttttttttcctccaaagtttttattgtatttatcagaaaacttaatataattttcatattcttccattcgttcatcatttctcggctgatatttacggaatagttttctaaattttttaatagccgcaagagtatcattctttaatctataagtactatcaatagaatttacactattgtaatatgcaatataatcatgttgattatttcggcaggatgttaaaaaagaaaaactgattaatagaataactccgcttatcttaatacatatttttttataattcattaaaaaagattttaattgactcccttataaaaccaaaaaaagctaaagagaaatcctctccttagcttctaaatgtttaaatgtactgcttaggcaggttctgtaataacagcaactagcttattgtctacatatactcctgtatcgcttccacttcctgtttcataagtccactgcttacttgtttctgccattaacccacctgtgatttttgataaatcatttaattttttgttttctaatgaagagaaattcttcattccatttagttttttcataattgatattgttttaaggatataaatatataaaacattaattaaataactctacataaaagtgatttttttattatgttaaatacctaaattaaagccttttacaatgaaaataaaaaccatattttttcactcattttagactaatcgaaagtatagaatatttttatataagtttatgacgttttttctaaaaaatccttaattatttatctttacagaatggtaataggtacaagacttaagcaagcaagagaaagtaagagaatgagctaggaagaattggcacttatatcaaaaacaacacagaaaactatatcaaattggagaacgacaaaaacattccccttttagattatttttgatttaatcagatggaagagttttaacttcaggatattttttacctaaagaagcagttaattgataagctatatgcttactcgataattcgatatctaaatcttcaatttcagaattgttatgatctaataatcatacagattaatgaaaccattgacagtttcaaaatggctataccattccggcagaagcttttatttataattgattttgtgattcaactctaaaggattattttcttcgagaatagatttttgcgcttctctgatcatttcattcatatctttttcatttccctcaggatctgtaaatataacttttttggcggttttggtattccaggggtcattataatatgattttcctagctgctcatattgtgtccagtcgattttaattgtttttgtccttatatcaaaccaattgctgcctttttttacctgtattaaattgaatgagtaatcatgttctgtatcttcaatggaaatgattaaaccaggtaatccattgaaaatatagggaccatcattaaaaggcaattccgtcgtaaaccaagcaatccagtttctaccaccataactaacttctgctttttgcgatttatattttccaatagttttttgttccggtatgattttccaatttagctgttcatcaatcggtagaacataatttgcctttaagtaagtaataattttctctatttttttattaatgatatcttttttaatataaaattgattttcaacccccataatatatcctccacttttattaatgagcttcagggaatcagcatttttggacatggaatctctaaaaatagaagtattattctccaaatccaaaatcatattttcagtattaatattttcaggtttttccttacttgttctatatttagcttcataaataaagctaaacttttgtgaaaaaaaagatgttgatagtagtaaaaaaaataaaataaatttcaatttgtgtggtattttcatagaatctatcgttttttgagactggattgattaagaaatattgttggataataatacaattataaaaaactaattgttcatctttaaagtatcaatcttggaaattgtctagaatttacctaatcatttaaaactttcctatatttataaagtaaataaaccttaaatatcaatataacattaacaacaaccataaataaaaataagataatttttattatcaaaaacgcagtgtcaatctgttttgtagattcgtctgctttttttacaaatgaaacagatatagtatcatttattttatattttacatttttatttatactaagattttttttaagaagaccgtaaataatagtgtctgttttatctgatatagaataatcattttcaaagtataatgaatctttttttttaattaactgcttttccaagtctattctgaatttatcgtattcactagtcctatccttgaaagtactatcaatttttttatattcgttctttattctaaaagcatttttcttattattaagcttcctattaataacaaatatggaatcagattctaatttctcgccatttacaatatataagtcattataattatgtctcttcgctctaagtgaatcttttttattcattggttcaaaattacttatagctgtatattgtggttctagtttataatttaaacgtttactactatacatttcatttttatctgaaggaaaaaaatctgccataatggaactggctaaaaatagtaaaacaatggaaaaaaaaattatataaaatttatatataggagcctctttttcttcaattacttctacactattaacattaataattctgtgatgaaattttgctcctaatttattcgcattatagtaagcattaatcctaacaaaatccttatttttaatttccttagtattaaatttaagtgtcttgtgttcaatttctaaattacaattaaataacagtgttttatctataactttatactttttccattctcctgttttatctgtggtgattagagaaataggttgttttatttcgtcttcttgaatatcttcatctccaagcataataatagtaccagaataaaaaaataaatatttacttaactcttcatctttaaacatcattttaaattctgaatgattagaaaaatctacattattcatcctaaaatgattgtgcagtaataatatttatttttttttacgaattctttgatataaaattatagctagaagggtagatgtaataagactaacaatagcaatccaatcagaggaagataatacatttaacatggttatttatcgttttttgagttttgttaataaactaaatatattaaggattacatgtaccttttataatcttaattttgaactttcaatgtacatactataatataggtgctgtctgacttatttctaaataatattccaattttcctaaagtcgaataaaaataaggatattttttaccatcaataatttctaagtttggaattttcctatttacaatttgagcatcattttctccataagtaaaaatttggccacctcttgcaaattcatataaattccaagatattacatctgtactttcaaaatatgatgtaagtctattacatattccactgtctccacttgtttttactggcagtacaatatttattaattcagtattttcattaaaaatctttgatgtgatatgagttgatttatattgtatcccatctaacctatcgttatttcttatccattgcagaagtaattgtggaattatatattcaggtttaaatgtatccattgggtctttgacctttacactgcagcacattattataggaaaagtcataaaaaatctgtataactcattaatatctgtacaatctttagaaggtggagttagatcaagtagttttatttcttttatatttttaaattttatagcctgaattttatcgattgacggacgatttaattcttcccaacagatgtaaatcgttctacccagatataaactaggaaaccccggtatgctaaatctttgggttgagaccttatttcttaattcaaaaggaatgtgaaacatttctgaccttttgtacagataattcttatcacttaatctaattctgaaaaaactttcatttaatgcatattccttttgattaataattgcatataaatctttaaaatcattacggaagactgtatgaagcttttcataagccttgaaaggattcccattataatagtcttcaaaacaaagtattagactttcaatgacttttccttgaacttcttttacaaaatccgatgaaatataatttttttcaatataaattggtcctggatctaaatcattaactttttctagaagtagttttaatttagtaataataaatgttttaaaattatcgtttgtagtttgatgtaacggtaactcaaaaattttatcctttaaaagttcctcgaatttcatgagttttcaatagttaaaagttattttatagtccactcaaaataaactaatcattattttcaattcctttattcattgtaatgattaccagtggatgtttttgtgagattactttaaaatattattcaattatctccaggaatttcgtaaacgtcatagaatcctacttttctcttgcctgatttattagtaattaaaacttcttttgcttttttatttttgatttcttccatgtttgatataaaaggatcaaaaacatatgatctcatatagcctaaattaaattctttatcatgcacatttacttttacttcagcatttcctccaaaaaacattatatgctcttcttgatttatattcaaaaaacctttatcaaaactttcatccagaacagcccttaatggtggtaatggcaattcaattaaagtattttccgccttagctattatagattcaagtgtgtgataattattctcgttaatgtcgtttctacttatgtccttaaatcttatcatgtgcaaagtttcaactttgcataacttttcaagatagttaatatagaactctaaatcttctgggattttatttgcaatgagtttttttgtaaagacagattctccatttaccaaaaatgaaaagcgaattccttcaataattttagcaaaggatttataatattctaaaagtactcttggatttttaataacttcatttatttcagattcataatttatattagctcctttagcaccttgcataaatgtaatagacccttttgctacatctgtttcaaaggataatacaactttcccttctactatatctttgtatacttttacgttaaaatccattacagacataccatcttcaaaaataatatcaattttaccttcatacgaaggaagtttcataatgtataaaaattccatgtctgataaatcttgaagtttgaaattatctacatgcattacaaaatcagataattcagttttaggaattctgaaacttttttctgcggtttttccttccataaaactttttaatttactaataaagtctttgttatttttagttgtgaaatgtactttctgttgtaagacaccatcaattttttctattttttcaataaaaaagttcgaggctgtattggtgccaactgttacattatatcctagttttttagcaaatttgtaggtactgtcagttgaaactttattactttttaggtctaaaaatatattttcatttatatggtcgaaaattaaaggaaataattcttctccagtcccctcaataaaatttataccataactacttagcttattctttttaggctgtgttaacgaaggagcaataaagaaaacctcttttttattgtcaccaagttgttttaaaatatcagtaaaaataaaatcgatattagtatcttctagagaataacctataaatagaatacagtttgtcgccattttatcctttaccgcattccaaaaaacggaattttggctgttagggctaaagaaattcgtataatctgtttttctaataattattgaattactgtcagctaaatgtccatgaattttatatatatgtgtttttttagtattagctaaactaatatgactattattatataaaacttcacaattttccttataagcaccttcaaatagtccatcgtaatttgttgttatgattgttttaaaatgaggaattgatgaaattatatcgtggacaaaagtagactctggtagctttgcataattttctttcagtatatttataacttcattattgctttgatataagtgaaaaatatcatcagttaaatctgctaatgaccgtgtcggttcaatatattcttttgcgctagctggtaaactattgtaaaaaatactttgaagttgagctcccataggatatccggcatattttgataaaccggccccagcaaaaagaatcacgtcttctctgcgaattaattccaataacctctctaaatttggtgttttttgcattagtaattatttgtactaaatattatcttattaattatgtgattttactatactaacttttaactattttataaaaagttgctttacttccaatattaaaagctttcataatttcctcaattggaacattcttactttcataagagctctttactaaaggtgcgattttttttatatttttcgatcataccctttggtcttcctccgtttttacctcttgccctcgcagccttcaatccagaatttgttctctcaatcaaaccatttctttcgtgctcagctaaaacacagaaaatctggaaaattaattttccactcgctaaacttgtatcaatgtgttcagaaatagatttaaaatgtatttctttttcattcagctctgtaacaaactgaattaacccaagtgtagtcctcccaatcctatctaatctccatacggttaaggtatcccctttacgtacgaaatttaataaatcgttaagttgcggtttttctgatttaataccactaaccttatcaataaaaatttttcaattcctatattctttaaagcatcagtttgtaaatcgagattctgttcaaacttgcatacccttgcatatccaattaacataagttcattttactcatttatttcaaatatattgtaatttgttttcatgtacaacgaaaatgaacttagaaaagaacaaatagctttactaacgagatattaatagatgtacgggaaactgacctcttaaggataaataaaaataaatattctataagtaatcagtttacggaaaaccgtagaaatgaaaagaactccaattaaggagttctttataatcgtcttcttcaatcattgaaataggctcaccaaagagactaatcaaggtcactaaaatcatccaccggagcgtaagggtttaccaatgaactggtcaggagaacagcacggatatcaggattgttttcagcccagtgaataatctgttccagcttttcttccctttctttcatattaataagactctgatatttttacacgatatacgtcagaagaatttctcttgattgattctacaaaaaaacctccttcttcgggaataacttctttcagatcaaaacttttgcaatctttcggaagacctgaaaatatcagggtaaaccaaaagtctttcataaaaggaaccggtgtccagtacggtgaaattgaaatattttctgcgtggatcagcttacttctatggtcagactgattatcaaaaagataggtcgaatgccagatcctgatcagatttcccaaaaacggagatgccgggaaacaacaatgcacaataacctgcctctcttcttctgttttcgcctgaagagattccaggatttcctttgcaatgaccggttttacaattacttcttccacctttttatgagtaataggtaatgagcaacaagtaatcgggattacttattgctcattattgatgttaatattctaattctaatttttcttttgtataatttcttacttcatcggtaagcgcaggattttctgccagtttctgtccataggatggaaccatttccaggagttttgctttccattctccatgaagtttttccgggaagcatttttcaagcacattcagcatggcataaactgctgtagaagcacctggcgacgctcccagaagagaagcgattgttccgtttttgttcacaactacttcagttccgaactcaagtttacctccttctttttcatctttcttaatgatctgaactctctgtcctgctacctttagttcccagtcttcttctttggcatctttgatgaattcacgcaaatgctgcattctctgagattttgtcatggcaacctgctggataagatatttcgttaaaggaatattgtgccaccatgctccgaaaagtgatctaagatttttcgtgttaacactttcaggcagatcaagatagctcccttctttaaggaatttggtggagaatcctgcaaatggtccgaaaagaagagctttcttaccatcaataattctaaggtcaaggtgtggaacagacatcggcggtgcatctaccgttgcctgtgtatatactttagcctgatgtttttctaccagttcctgattatgacttaccagccactgtccggaaaccggaaaacctccgtatccttcactttctttaatatccgaactgtccagtaacggaagcgcatatcctccggcaccaatgaatacaaagtcggcaaccacttcctgtttgtgattattgatcctgtcttttaccttcatttcccattgaccattctctctggcatcaatatcttttacttcatggtacaggaatacttctacgttggaatcttccaggagatgtcttcccatctttcttgtcagtgttccgaaatttacatccgttcccatatccatttttgtagcagccattacctcagactggtttcttttgctcattaccaatggaatccattctctcagtttatcgtgatctgtagaaaattccattcctgagaacagaacagattctgtcattttatcgtgacgcttttttaaatattcagcatctttttctccgaatacaagactcatatgcggacatgaattgatgaattctttcggctgatgaatatatcccttagtaatcagataagcccagaattgctttgaaatttcaaactgttctgcaatgctttctgccttggtgatatcaatagatccgtccggcttttccggagtataatttagctcacaaaaagcggagtgccctgttccggcgttgttccatgctgctgtactttctttggcaaaccttcctagcctttcgaagattgcaatttcaagatttggatcaaattcatgcagcagcgttgccaaagtggcgctcatgattccgccgcctatcagtacaacgtcgtatttaggtttcggtgttctgcttgtaagcgattgtgacataattttaaattttacttcaaatttcgggaaaagttttaaaaaccggaacgcgtttaacgattttaacacgttattttttgagtcagaaacacttctttagtacacaacaaaaagccatcgaaaatttcaataaagtactattgaaatcattgatcattcttatataaaaatgaataaaaaaacttaagcactggatgcttaagttttaattatttacaaacaagatttaataataaatcccagtttaattcagttttgccgtcagttttttaaactgtttctcagcatttttaccttcataaaggatggcatataccgtatcaataatcggcagcttaagatttttctgttttgccgttttataaatggaatctgcagcataatatccttccgcaaccatgttcatagactgaatggcagattttaccgtataaccttttccaatcaggtttccgaggtttctgtttcttgagaaaagtgaatatgccgttaccagaagatcacccagataagcactttcgttcacatctcttggtgcttcatagatggcttccaggaaagtttccatttcacggatcgcattggaaacaaagaccgctgtaaagttatctccatatcctaatccgcttgcaatacccgcgcctattgcaaaaatatttttaagaatagcactgtattcgtttcctaaaatatctttacttgtatgaactttaataaagtctgagctgaaaattccttcaagcttttcagctgtttcatcttctgctgctgcaatcgtaagataagaaagtctttccatggcaacctcttcagcatgacaaggtcccgcgataaccgcctgatttctgaaaccgattttaaattcatcccgcagataatgggctaccacatcatttacttttgggataattcctttaattgcagagacaaagatcttatcagaataatcacaagtcatcttatccagtgtatcagacagatagatcgacggagttgccagaacgataacgtcacacgcagaaaccagttcattaatatccgttgtcagttttaaacttttaagattaaaatgggcagccgtaagataagtcgggttatgtccgcgaagctcaatagctccttttacaaattcatttcttacgcaccagtgtactactttgcagttttcaacaagcatttttacaatagcggttgcaaaacttccgctacctacaactcctacagaaacatcctttttattcttttttggattcgaagattctgaaataattttctttttagccataattggaatgtgaactgcaaagatattaaaacaaagacggaacgcaggctttgaaaccatgataaaagccattttctgaaaaaattaacacttcaacacaattaaacagctaattaaccgttaaatacagaaaaaactgaattttaattaaaaataactcacaaaacttatttttaattaaatttgcagcttcaaaaccgttttaaatttactaagagaagaaatatgaaaaaatttctaaacagcaagaagaacgtaaacattctcctgggagggcttttattagtagtttttgcacaaggtgtcttcatagcaaagctcttttctgaaagagatgataaaacctacgaagtgaatcttgtaaaaataaacactgaaaaagacagtgtagattacctcaaaatgaaaactgatcttactcttgtagatcagaccgttgaacagctcaactccttcctgaaatccaaagacattaccaacgaaaaactgatgatgcttaatcaggacagtatttcaaattctatttatctttccaagcaggctaaccgatacagccagtatctggtggatcttcagaaaaaactgatgcaggtaccattaggaatgcctacagatggctatatttcttctaattttggcgtaagaaaaaatccgattccgttcaaaacggtttttgcttcagtaagatcaggtgcgccagcagaagctaaatcggcagttgctgcagctccaaaacctgaagtaaaagctgagcctgttgaaaaggtcatagaacttacagacagctacggaaataaaagagaagtaaaagtgatggttactccaaaagctgctcctgtagcttcaacatcagccccggcaactaccaaagttgctacgggcaataccacaacacaaacaactgttgctgaaaaaaacaacccacctgctgaagctgatcagatgcaattccacaaaggtctcgatattgctgtggcttatggttctgatgtaagagctgccgctgccggaactgttattttctcaggacagaaaggcggttacggaaactgtgtgatcgtttcccatggtaacggattggctacattatacggacatttatctgaacttatctcaaaagtgaatgataaagtaaaagtaggtcaggtcattgctaaatccggaaataccggacgttccacaggacctcatcttcattatgaagtacacaaaaacaatactccggtaaacccgaaattgtttatgaatctataaaaagaaaactgtctctctattatgatataaaaaaacagctgccaatgcagctgttttttattttaaaatcctaagcgttcctttcggatgggtgaatgtaccatcggaacctgcaatatttgaatacacaatatttttattgtaatcctgaacatgagtgacattaaagccaagatgaggctcatgccaatacaccataaaaacattctttgctacttctacagcagtatattcaaccgtatcggtactgttttttgaacttcctgctgttcctgtaaatgtcatggttttgttgtctttaaaatcgagaacgaattttactcctccaaaatccacttccaatttatggccgatggccggatatggtgattttaaatcccattccatttctttaaggaaaacctttactcccatctccagttcttcttttcccggaagatcaggatattttttaaccataaaatcaacaatagaagatgaagttttgttctctgtcactgcttttttataattttccaagtaacccttcacaaaatccagagattgtggagatgtagatggttctgcaaaatgggaaggaatgacctgctccggatttaatgctttcatggaatcaatctgccctatccactggtcaattgcttttacattctgagtgtctgccatccatagatgtgagtctacagaaactgaaatgccaccggcaatggttttaatggaagggatccaaagaaagctgtgcgcaggatcttccggattctgtctgatctcaattttgtttccttcaagatcatggattgaagcagctgcctcaggaactataatttctgatggagcatccgccttgagttgcggtttccatactcccatcttatcatcttttgaagctgatatcaggtaagctgtctgagccgttgagataattttagcgttaggaaaggcttttttaatgacatccaatccaaaataaaaatcgggatcactgtgcgaaataaaaacggttttcagattctttcctgttgcctttatctctttcaccagctgttcagcatattgtttctgaaactgggcatctaccagtatagcgtctttatctccgtaaataatggtagaagtaatcgggaaaatagctttggttcccggattatatacttttactttgagatttcctgcaaatatgctgataaagcccagtattgcaagtaacgaccataattttttttgtatcatttctgttcttttatatattaataagctgctgtaaaacgttcacggatgtggttgttctgttctaattcatctaccagagctactgctacatcttctacagacagacggcttcttccgttttcatcaaataccggagtttccagtgcagttcggtattttcctgttctttctcctacattagcctggttcatttcaattgcaggactgaagaatgtccaatccaacgtgttattttctttgattttatttaaataatctcttgctgctgttgcaccgggcttgtaagcttcagggaagtccggagtatctacaatctgaacgttatccggtgtgtaaaggcttcccgctccacctactacaatcagtctttttacgcctgactgttctactgctttctcaatgttctgagaaccgtttaagaagtcgttgtaaagattaggatttgtccatcctgcattgaatgtactgattacagcatcattccccttcagtgcttcagctaatgcatctacattgtttacgtcaacacttttagcggttacattttcctgtgtttttaccttcgacgcatctcttaccaatgcttctacagcatatcccctttctgccaattctgttactacatgtgatcctacaaatcctgttgcaccaattactgctacttttttcataatgttttattttttaaattaaattgtaataatttttgttacatttaagggtaaaaaaattttattcgaactgatcggtaaattcctgtaatgatttgtctcctaaaaaattaataaccaaatgatctgtttcctcaaataaggtatttaaatgaatatttatttctttcccgacactgcatgcgggattgggattctgatttttctttcctaatacttccgtatttttaactgctttatagatctcagaaattgtgatcatatctgcattttttgcaagctgacttcctccttcttttccctgtctgctgataatcagacctgcttctctcaatacgctgatctcctttcggacgatcaccggattcacattgatactaccggccatccagtctgaagtaagccactcctgaggactctttgccaataatgtcattatatgtactgccgtagcaaatcttgtattgttcattgtaattacagggcaaagatacacattttttaaatgtaacaaaatttattacagttaaatttttcttaaaggattaatttgtccagatcaagcagcagataattgatgttctgattaatggtacgtgttgccgactgcatctgattgagcatggctgcacggttatgaagatcatccgccctgtaatacccgccatcactgaaaatgacagatttgtctgccgcttctttattatcgtcaaactggtagtgaagccatctcatcttcatattcccgatgatggaatgttcttccctgttggaaaattttttttctgtatacatataccagataaaaggcggaaagttgggcgattccagcttttccctccagatatctctcaaaagatttctctgatggataaactctactttttttcctttgggattaagagtcgctaaaccaaagcccgctcctaaaacccctcctccgatatcaattgcattgctccaaccctgatcatgaacaatacctccggctatagaagctgctgctccggtaataatggaataaaggatgagcttattgttttttgatgagttcaggttatccacataatttccaatctgggctactctttccccctcacagtcaaattctgcggctactgcatcaagttctgtcagggcaatcgtgattttactgtttatttttgtttttaactgtaaaactttgacctgcgaagcaagggatgagtcttttttaagatcaataatctgatggacctcatctaagttatccagtgcattcaatatcaggatactctgatcggaaaatatctctttcaattctttattggcagccaggatagagtctgcattataagatggaattttattgctgtagttatacttaaaaggtgctttacaatagctgtctttcagcgtaagtatattctgctgaatagcctgattcttctttgagacacaagaagtaagaagcccgaaaacaatcaaaaggtaaaaaagttttttcattcagtcatatgtttgtgccggattgatctattgtaacccaaccgcaatttgtctcagctttacaattcatcaacacgaatataatacaaataaaaaaaattacctgaaatcaggtaatttttttatctatttttaagaaggtttacttaatatccagcaattcaacttcgaaaacaagggtactgtttggcccgatctctttgctgatttcctgatctccatacgctaagtgtggaggaataatcagtctccatttactgccaacagacattaactgaagagcttccgtccatcctgaaattactctgttcaaagggaaagacgccggagttcctctttttacggagctgtcgaatactttcccggaaatagttgttccgtgatagtggcattttacagtagacttaggacctggtttcggaccgtcaccttctgtaatgatttcatattgcaagccgcttggtaactgtactacactttctcttttaccatactcttccatatattctttaccgtctttcaggttcttttctgccaattcttttttacgtttaaataacatatctgctactcccatattataattttttacaaagataaggctttttagggttgaaagatggaaatgagagaatggaagtttaaaatccaaaattcccataaaaacaatcatacctttaacaatcagtaagttaaatatcttattcattcgaattcaacaatcatattattttacatttattagcttaaaaggtcttttccacaaaattcaaataattgtaatacttgcttaacacagatttcgaaacttggcgttataattggatttaaaaactaaatgccaaatccaataaaatataataagaagtttgatgaactgaatgaagaggaaaaaaaacttctggaaatcaataaaaaaacaattgcagattttgttgaacaatcctcttccatcagtgatgtcaattatgctacaaggaacgctcacgccaaaacctatgcagcagcaaaaggtacgttcgttatagaacctggccttccggaattactgaagcctttttttgacagggaaaaatttgacctgatcatacgattttccaatgcccgcctgaaaatcaaaaattcgggaaaagatattcctgcctatggttttgcggtacagatcagggatgaaaacggaggtttactggccaattatccattagtcaattttcctttgtttcctcttaactctgtttcaacttttctgaaactttttactgctgtcaatatgttttatatgaaaaaatggaggagcctattaccgatgttttttcagataatcaaaatgttcccttatgtttgtaccggtgatatgctgcgtaatttaataaagcttttcagaaaaagaaatgactttattctgtcgtttgattattactcggtaggtgcttaccgtctgggagatcagatcattaaaataaagctatctccccaatctgtggataaaaatgtaggaagaaagcaaaagataggagacgctttaaaaagttatctgcagactcatgattttaaagcttatgttttagtgcagatctgttatgacgtgaaggatcagccgatcaacagactgaatgttgagtggaaaaactctccttttattaaaatcggtgaggtcagaatcaataaaaattctttgctggatgcaaggaactgtaccaatgaattgctttcattcaaccctttcgaaagtaaaatatttttccagcctgtaggaaaaatacagaaactgcgtgatgaagcttataaggtttctctgcagacgagaaggaagattaataaattgctgcatggaaaaaacagctaaaataattatgaattatgagtgatgaatgatcatttattgacttgacgtttcagtttcctttaaaaagcttttaaaaacaaaaatgactgttgtactaacagtcattctattttatctgaattttctttcttcttctttgattgccagatcattgatgcttgcatatctttttgccatcaggccgttttcatcgaactcccagttttcatttccataagccctgaaccagtttccctctttggtctgatattcatattcaaagcggacagcaatacgattgtctgtgtgtgcccaatattctttcttaagcttataatgaagttctttttcccattttttctgaagaaatgttacgatttcttctcttccatttacaaaggtatctctgtttctccattcactgtcgatagtatatgctttggaaaccttttcgggattctgactgttccaggcatcttctgccaactgaattttttcaagtgccgtttcaagagtgaaaggcggaagcggatgtttctgttccataacttactgtattagattggtaactattttttttgatttttcgatcaattcattggatttgaaaagctggctttctataatgctgctctcaaaaagcatgtaaatatgatcggaaagctcatcattattaagcaattctaaaaagaagttcctgagatctgctttatgggattggataacactaaggattttgagattatccatgggaatttccgataaaatattcaggaaactgcaaccccggaagttttccttagcattcatgtacaccagaaaatcaaaagctttgatgagtttatattttggatttttttcttttgataaaaaactattgagttcatgaaaccaatattgatgtcttacattcagaaattccacacacaggtcttccttggatttaaaatgctgataaaaacttgctttggctacttctgcttcggaaataatctggttgataccggtagaattgtatccttgtctggtaaacaattgaaatgtggtttctatgattctttctcttggagatttcatatcggatttcttttctggaacaaatgtatgaaaaaaaataatatacagaccagtctgtctgtttgattttttcataatatcttttagaaaaccaaaaggcacgaaaaattaatggatactgtgtagtaaggcgcaaggattttatctccgataaaatttaatatctctaaaaaagagaataattattgttaaaaatctttgatttccttgcgccttaaaaacgacacagtgcttatcctttttgcgcctttgtgtttcccaacaaaagcgtcatcaacaaaaaagcccctagagctatactccagaggctttcatttattttaattatgattatttttcttctaattcttctttcttctcttcttctttttcagggaagatgatggataaaagaactgagattaccaacactccccctacaattcccaatgaaaccggagacggaatatggatccacggtgcaatcaacattttaactccaatgaaagacaagataatcgccaatccgtatggaagtttgctgaacatgtgaataaagtttgcaagcaggaagtataatgatcttaatccaagaatggcaaagatatttgatgtataaaggataaacggatcatttgaaatcgcaaagatcgcaggaatagagtctacagcgaaaagaacgtctgtaaattcgataacccctactaccactaaaagaggagtcgccattttgattccgttctgaatggtgaagaatttatctccgtcatagttatcggaaactttccagaagcttttgatcagtcttgcacctgctgtattgctgtagtcttcatcttcatcatctccaccgtctccccatgatttgacccctgcataaacaagaaataatccgaacagtgtcattacaacgttgatttttactgcttccccaaagatattcatttcaggaagataggtaagattaatcaatcctactcccgcaaatataaatatggccctgaagatcagtgcaccgatgattccccagaaaaggaccttatgatgaaggtatttcggaaccttgaagaatccaaaaaccaggataaaaacaaataagttatccactgagagcgctttttcaatccagtaagcagcctgatattgtgtgaatttttctactgccagagcatggctttcaggacttccatcggtattgaatacccaatataccactcctgaaaataccatagaaagtgagatccatacaacagaccatatggtggcttctttggaagatacttcgtgactttttttgttaaatacccctaagtccaggagcagcatgataacgactgttactgcaaatccccacaccagaccagggtgcagttctaaaatactttgatgttccacttgagttatgttataatatgataaaagcaatagatgtacattgtacaaatattgctattttatttattttccgactgacaattgattatagataattcatctgtaccgtctggatcgtctgttccagttttttgtcagctgtagggtctccgatagcattgaatttccattctccgtttctcttatagaaaactcccattaccatagcgacgtgccctttgaaggaagcatcgtttgcaatatcatattttgcaaaaacttctcttacattagtaggtgttccttcataaatacggatagaagcaaaaggaatggttccgaaatcctgacctctgtagctgttcagcaccattgccacatgctctacattgggttccagattactgaagtctaccgtaatcacttcgttatccaatccgtcatcgccgtctacatcaccggtaaggtcatctccgctgtgtcttacagaaccgtttttggatttaagatttccaaaatagattacttccgtaacgtttttgtttgaatcatataaaatacagcttccgtccaggtctactgcttcttttttagttccgaaaaatcctttctttacaattgctccccagttgattcctacgcaagcctgggatagtacagctccattttcttttttaaggttaattctctgacctttttgtaagttgatagccatttttttatgtttagttgttatttattttttagcaaaagggcgaaaaagccggattgcgaaaaaagcaaatttgcgattttactgttttgcaattttgcctttaattattattcaaattcaaattaagcattgcccgcaggatatttgtctcttcattgaaatcaaatatcttgctcatgatatctatattttccaggtttcggatataatctttcaaaacagcttccacttctgccggaaggaaacgttttctttcgttcatggtgtgctccaactgttcatttttgcttctcagctgatcaataatggaactttggttagactgattttcagaaatatccagcttatccagttctttgtcgaaaagatacaatttcttttcatccacgctgaaaataaaataatcatcagtctgaaagatcctgaaaagctcataatcgtgggttccgataaggtagccacatacaaaacggactttaaaaccttgtatattgagccttcccaataatttcctttcaatagaataatctttgtactgatacgaggggaaagaatcagatttcagcagagtttcgtctgcatccgttctgtaaaattccctggcatattttttatgaaagtacagtacattatcccaattggctgtaaagcgatcttccgtaagatcctgatacaaggttttcagatgttgggaaaatacaccgctgtacattttcctgtcggtctgaaagctgtctacccgtctttcttcaaaacctgaaatatatttattgttgatgttaatttcgttaataacagccagcatatcattttctttctgctttttaattttggtcagaagttctatgagactgtcagtatactgcaggtggaaaagttccagtttattataatccaaagctgtattttcctggaacagattgtggataatatcagttttgatataaattgatatgatgtcaatatgttcaaaaaaattagcgagaagcttaagtctggttaaccttcttttgctttgtgacaatatggttgctgcatcatctcccacctttgtatcctataaattaacctctgacatttgctttaagttcatgctccaatgtctgaagatcctgatccagttttctcctgttatctgcaccctgtttctggatttgcttcacttcattcaatgtattgatcagcattgatgttgtttctctcaatgtttccacagatacgatggtctgctcgtttgctctggcaacattcacagaattctggcctagacgctccgcattctttcttaagatttcttctgtagtggaagaaactttctgctgaatttcaatattctgctgctgtctgtacattgccacagccagcgaaagctgatttttccagaccggaagtgtagtggtaaggatcgtctgagctttttcagcaattgatacgttgttattttgtaccagcctgatctgcggaagtgattgcatcataatcacacgcaccaccttaaggtcagccattcttctgtctaatcttgcaatgaaatctctcttatccgcaatctgataatcctgataattctgcggattggcttccattacagcaagctcgcctgcagctctttccattctgatatttcctgcaatgacaagctcttcaatctgcttaatagaattcacattgctttcaaaaatagtctgaagcacagcattgtcttttgtagacgtgatgattcctgcatttactttatacgagatctgctcaatattattgatgatcttatcgtattttgcaaaaagattttccacctgagtcattacctttttcataaatggtaatttgctcaggaagcttttcactttatttccgttaagctcgtctacatctacataattaagctccaccaaaagatcattgatgagccctcctacttctcctgaatttgatcttcttacattccccaggaaactgtcactctggttggataatgttttctgaagatcagctccgaaatttacgatggaacccggattgctctcatcaatagaattggcaagaacttcatatttctggcgttcttctgactgcagctgcgtcaggtttacatttccctctctgtccacaagaactcccggcgctgcgttttgaacaggctgagaaggagttggaggaaccattggagttggttcaaaggttttaagaggctctattgatcctagcggatctatgggttgattttcctgattgtccatgattacttctgataaattgatacaaatttctcaaggccctctctttggcctgcccctacagcctcaaatttccattctccgtttctattgtagattcttccgaattctacagcggtttcgatggagaaatcttcatctaattcatattttaagatctcttcattcgtatctgtattaaaaattctgatgaaagaatttcttacctgtccaaagttttgctttcttgaatctgcttcatgaattgttaccactactgtaatttctttgaccgcattatcaatttttgtaagatcaatcctgatctgctcatcatcacctgctccttctcctgtaagattatctcctgtgtggattacagatttgtccggagactcaaggttattatagaaaatgaaatgattatctgaaattaattttttgtcctctccaagcaaaaataatgaagcatcaaggtcgaaagccgttcctgtagaagtattattgatatcccatcctaaacctacagtaaatttaggtgcgttgatattttctctttgtcctttttgtaagttaatagccataatataattcagtttgtattaaagtattgatgttgttttcgtattcttttattaaatgataattgttactgatggcaagctccagaagaagatccatctgttccttttttactttagacgtaagataatcaaaattacctgaatccaggcctaaaatatattttacaatccttgtattaaactgaaagctttccttattcatcacttctgcgacgtgatttacattttttactgcatagtaattgaaaaagttttcaatctttgggtcaaggtcaaaattcatcagttctgcataatacagaaacataaagtctgcttcaaccttgtattcatcaagaattctgttcactgtatattcatggctaccggttattttgatatcgtctataaaaatacaaagttttcctctcaaaaaatccttatcgatataatacgtatcattggcaatcagatttttgcggtcttcaaaattaagattcccataatctgtaatgtatgtatgattacggttaattttcgataagacgcttgacttctttccttgttgaaacagataaaagtccagattttttttaaaataaaagcataaaaaattggaagccgtaggaattgccatataagggcttggaagcactacaatctctctatcagtctttagaagctgttcgttttcggaaataaacccgtcaaataattctcttgcaaatttttcagcatacgacttatcgccatatttgaaataactgtattccgcaggtgagaacgtaaactcatccgccgaatgaatgtggtgtaagctgtatcttgtattcatgtttatagttagtgtttaagtaaatgtgcactgaagccgaagttcttcgctccctgataatctgctaccggattgtctccgatatgcaggatccggttcattggtaaatcctgatctttaatattcttcttcacttcctgaaaaataagcggattgggtttggaacagttcatttcatcggaatagatatggaaatcgatgtactgatccagattttcatgaatcagaaattttctcatggtagttcctttgataaatccggtattgctcagaatattaatagtttttccctgatttttgatatcttcaaaaaagtcatgaatattctcgaaaatcacaaccggtctgtactccagaaacaattcttcacttttattgtaaaactcattgagtttttctctattcaaagattttacatcaacattcagagctccgagaatcatcaggtaaatttcaaaagtatctatatttccacctgtaacttcattaatggtattgcaaagatcatcataatattttacggttttcgcaacttcctctatcggtttatctacgttaaaaaatgaggagaacagctcaactcttttggccttaaattcaggatgagatttgattaaagtgagccacaggtcaaaggaaaaatgacagtggttgtgaatgtcgatatctgttttcaatagttttaagttaaaagtttttatttagcttcttgaaaaagatttaaaatattctaatcatcaaaaagtgtttacgatactattcttcccaaagataaaatatttatcataaaagcattatgtctgttgtctgttttaagatatttttatgaaaattcaaagttttgtgtggatcttcagaagatgttttttatgaggtatttaaaaaaaatttcaaaaattctttgaaaatcaaaaaaaaattataatttcgcaatcgattaaaaatcaacaatgtcaacaaaaatgataaatagtataactttaagcaatcctgtcagagctgtgttctttggcagcactgaatatttatctaaatagttttatagatcttttatacccaaaaatatattgaagacctgtctattcggataggtcttttttgctgccctgatttcagactttaacaattcaacgaatttgtgttatttgttaagatctctgaaaattttccattgttacaaaatacaaaaatgtttagccggctttatgagaccggagggtattttgcgctcttttttctgagaatcttttataatcacagatctaaaaatcaacaatttaaaacaaacaaaatgaaatacaacacacgaaatatagggattatagcacatgtagatgcaggaaaaacaacgttatctgaacggcttctttattacacggggctcattcataaaatcggtaacgtagatgatggaaacaccaccatggataaagatattcaggaaagaaacagaggaattactatttcatcagcggcggtttctacccaatggaaaaaagacagtaaggtttataatattaacattattgatacaccgggccacattgattttgcagtggaagtagaacgttctttaagagttctggacagtgttgtagccgttttctgcgcttcttcaggagttcagccacagactgaaaatgtttggtttcaagctgaaaaacacggtacatccaaaatatgtttcatcaataaaatggacagaattggtgcagacttttttgccgttcttgaagagataaaaaccaagctgaatactgttcctctcgcccttcagattccgattggggctgaaatacattttgaaggagttattgatcttgtcaaaatgaaagcactatactggaccgatgaaaacggcgaaatcattgtggaaagggaaattcctgatcattatattgctgaagccgacgaatacagagtaaaactaatggaaactcttgcagaaaatgatgaacagttctttgaaacattcatggatactaaagaaacagtaactcccggaatgatctcagaagccattcaaagagtctgcagatccggttcagcggttcctgttttatgtggttctgcttttaagaataagggaatccagcctttgcttgatgctgtggtgacttatcttcctgctccggatcaacttgccgatctgcagggaaaagatcctcatacagaaggaagtgtaacattgaaaagaaatgaaatggcttctttttcagggcttgtcttcaaggttgtgattgataaacatatgggaagactggcaatgttgcgtgtatattccggagtgattaaatctggtgataccatattgaatgtaagaacaggcgaaagttacagggtttcgagaattttacagatgcagtcggataagacgttgtccatgggtgaagctaaggcaggagatattgttgctttgacaggaataaaggacgccaaaaccggagattctttatcatcccctgatcagccgatattactggaagcaatcacgattccgactcctgtgatccgagttgccattgagactaaaaccaatggagatgagaaatctttcggtttggtgctggccaagatccaggaagaggatccttctttggtggttgagagagatccgcaaacaggagaaaccttactgagtggattgggagagctacatcttgaagttactttggagaaaatccgtctgaaccatggaattgaaatcaatcagggaaaacctaaggtttcttaccgtgagatcttaacaacaaccaaagttcacagagaaaagctttccaaacaaaacggaggaagcggtcagttcgctgatattacttttgaaattggaccaggaaatggtaatgaaccaggattagagttcattactatgattaaaggcggagttattccgactgaattcattccttctgttgaaaaaggattcagagaagctatggaacaaggtccattgaaaggataccctttagaaaacatgaaaatcactcttctggatggttctttccacgctcaggactctgcagcctttgactttgaaattgctgcaagagaagggtttaaagcggcagcaaaaggatgcactcctaaactgatggagcctatcatgcaggtagaaatccagagtattgaggaatacacaggtgctgttactgcagatatcaacagaagaagaggaatcatcacatctattgatgaaaaatccggaagaaagatttttgcagcagaagttccattagccacaacttttggatacatttctgatctgcgcacactgacgagtggaagagcttccatcagcatgaaattatcacactatgctttagtgcctgatttcatcgcgaatacattaataacctaaacaagcaaggactgtagatttttcttacagtccttgtctggttatgggatgtctattgtgaatagccaatcgtcaatacgctgcgcttgtcaattcttttatgctataaaaaattcacgattcatttgcgaagcaaaattcacttattgactgtgaaattgtgaatgatcaatcgtcaatacgctgtgcttggcaattcttttatgctataaaaattcacgattcacttgcgaagcaaaattcacttattgactgtgaaattgtgaatggtcaatcgtcaatacactgcgcttgtcaattcttttatgctataaagaattcacgattcacttgcgaagcaaaattcacttattgactgtgaaattgtgaatgatcaatcgtcaatacgcaagcgttaaaaactttgagtgagtcagacaaacatacaatggagagtttgatcctggctcaggatgaa

SEQ ID NO: 26 - DNA, 1328 bp, Chryseobacterium sp.
cgaacacagaagttaagcccacgtgcaaaagtaaaactttattttttaatgaccaaatgtttttgaagaaaattttaaagttttttaagtaaccttaatccttctcaaaccctcaatccctctactcttgcgctccgatttattcggactgcaaagatacaaactcttttttatctcacaactctttttgcaaaaagttttaaagttttttccgtctgtctcttgtgaagtaaataatgttcctgcttaactaaaagcccttctgcgcttactgatctactctcgttttcagtggggcaaagatagtaacttcctacaacgcaaaacaagtttatttaacttaaattttacaatacccaaaccattgtgagtaactatactatttaatttattgatatatttatagttatacaaaaactaatacttatccacaataagtcttattaaattttaaatcgaattattatgctaatattaaggattacaaaatgtcacaatttttttagctgataatatatttaaaaatatgtaaaaattaagattaaccatttggtgcatccaacagcataaaatatgaaagcaatagattacaaaagaagttatagcggaattttatgttcaatcttatttcagcagatccggttccgggatgttgaataatattttatggtaagagagcaagttctaaatgaaggaattcgtgattcgggatatgggttcagtggtatggatttctgggattgggcgaaagtaataaagttacacatcatgagttataagaaccctctgttcaatggccttactcctattctaattggggtcataaagcatccttccccattgtactgaggttcaactggcctctttcttttcatttgtatgggcttctttcctactgtgtcattccgcaggaatccaggcttatttattagagccttaaaggttcaggatgaatgatgaatgatgaatgatgaaagcattgaatgcttaagtgattataatgaaccattattgcttgaatgaatggcttgtttagactcctacggagtgacaatggggtatgtgatgaatgatgaatgttaagtgataagtgatggttgatagttgataattgattgaaatatcgtttatcatttatcaattattacttattacttattacttattacttattacttattactcattgcttataagttgggtataaagcaaaaaaaatcctttatcatttgataaaggatttttaaaaataaaataaaaactggcggcggcctactctcccgcgttagcagtaccatcggcgctggtgggcttaacttctgtgactg

SEQ ID NO: 27 - DNA, 5280 bp, Chryseobacterium sp.
aaagcggaagatataaagatcattgacatacaatataacaaccaagtaaggaaaaactaaagcgttaaaaactttgagtgagtcagacaaacatacaatggagagtttgatcctggctcaggatgaacgctagcgggaggcctaacacatgcaagccgagcggtagagatctttcgggatcttgagagcggcgtacgggtgcggaacacgtgtgcaacctgcctttatcagggggatagcctttcgaaaggaagattaataccccataatatattgagtggcatcacttaatattgaaaactccggtggatagagatgggcacgcgcaagattagatagttggtgaggtaacggctcaccaagtctgcgatctttagggggcctgagagggtgatcccccacactggtactgagacacggaccagactcctacgggaggcagcagtgaggaatattggacaatgggtgcgagcctgatccagccatcccgcgtgaaggacgacggccctatgggttgtaaacttcttttgtatagggataaacctactctcgtgagagtagctgaaggtactatacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggctttcgggttcagagactaagcgaaagtgataagttagccacctggggagtacgaacgcaagtttgaaactcaaaggaattgacgggggcccgcacaagcggtggattatgtggtttaattcgatgatacgcgaggaaccttaccaaggcttaaatgggaaatgacaggcttagaaataggcttttcttcggacatttttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccggtacagagggcagctacactgcgaagtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttagagcgtcgttagacgataaaaaaaattagtatcgcaagatacagaacttacttaaagttcaagctttagttttttgtttggttgatttatattaaaaatacaaaacccactagaaattagtaaagggattgagagaggcaaagaagataaaagcagagagagaaagacgaagaaatgagtctattatctatcagtctatcatcttttacgtctaaaagacagtctcgtagctcagctggttagagcgctacactgataatgtagaggtcggcagttcgagcctgcccgagactactaattaaagcggatagcaaatagcgactagcttctggccaatagccaatagcaggaagccataagctaaaagcactagagggggaattagctcagctggctagagcgcctgccttgcacgcaggaggtcaagggttcgactcccttattctccacagttttggaatactgatttaaaagttacgaatggagccaaaaacaacatttgttcatcagtatgaaaagaagacattaagatcattgacattaacggtaaagacatcacaaagagaaaaccgagcgcataaagcgcttgagtaaccaataggaaagaaatcgttaagggcgtatggcggatgcctaggctttcagaggcgacgaaggacgtggtaagctgcgaaaagctgcggggattggcacacacgaattgatccgcagatatccgaatggggcaacccggcatattgaagatatgtcacctcgtaagaggagcaaacccggagaactgaaacatctaagtacccggaggaaaagaaatcgaagagattccgtaagtagtggcgagcgaaagcggattagcccaaaagcttttatatgtttaatagaatgttctggaaagaacagccatagagggtgatagccccgtatatgaaaggcatatttgagtgataaatgagtagggcgggacacgtgaaatcctgtctgaatatggggggaccatcctccaaggctaaatactcctgaaagaccgatagtgaacaagtactgtgaaggaaaggtgaaaagcacttcgaatagaagggtgaaatagaacctgaaaccgtacgcctacaagcggtcggagcagcgtaatgctgtgacggcgtgccttttgcataatgagcctacgagttaattttactagcgaggttaaggtattaagtaccggagccgaagcgaaagcgagtctgaatagggcggttagttagtaggattagacgcgaaaccttgtgatctacccatgggcaggttgaagctctggtaacacagagtggaggaccgaaccggttgacgttgaaaagtcttcggatgacctgtgggtaggggtgaaaggccaatcaaactgggagatagctcgtactctccgaaatgcatttaggtgcagcgtcgatgttaagtttattagaggtagagctactgattggatgcgggggtttcaccgcctaccaattcctgacaaactccgaatgctaataaatgttcgtcggcagtgagggcatgggtgctaaggtccatgtccgagagggaaagaacccagaccaacagctaaggtccccaaatatatgttaagttgaaacaacgcggttggactgcattgacagctaggatgttggcttggaagcagccattcatttaaagagtgcgtaacagctcactagtcgagcggtccggcatggataataatcgggcataaacatattaccgaagctatggatttataattattatatctggtaggagagcattctatttgcgccgaagcagtactgtgaggtattgtggagcggatagaaaagaaaatgtaggcataagtaacgataaagcaggcgagaaacctgctcaccgaaagaccaaggcttcctcagccatgctaatcagctgagggttagtcgggacctaacgcgaacccgagaggggtagtggatggacacagggttaatattccctgacttgctcacaataaaaggggacggttggatgtatctgctggagactgacggaatagtcaaggcctagccttcgggcgaagctgctgtagagtaatctgatccaagaaaagccgaagtgaagcaacccgtaccaaaaccgacacaggtggtcgaggagagaatcctaaggtgctcgagtgagtcgtggctaaggaactaggcaaaatagtctcgtaacttcggaagaagagacgccatcagcaatggtggccgcagtgaagaggcccaggcgactgtttatcaaaaacacaggactctgctaaatcgaaagatgctgtatagggtctgacacctgcccggtgctggaaggttaaggaaggtgcttagcgtaagcgaaggcattgactgaagccccagtaaacggcggccgtaactataacggtcctaaggtagcgaaattccttgtcgggtaagttccgacctgcacgaatggtgtaacgatctgggcactgtctcagccacgagctcggtgaaattgtagtatcggtgaagatgccgattacccgcaatgggacgaaaagaccctgtgaacctttactataacttcgtattgactttgagtaagtaatgtgtaggataggtgggaggctttgaagcaggcacgctagtgtttgtggagccgacgttgaaataccaccctttacttacttggagcctaacttctttcagaaggacattgcgtggtgggtagtttgactggggtggtcgcctccaaaagagtaacggaggctttcaaaggtaccctcagcacgcttggtaaccgtgcgtagagtgtaatggcataagggtgcttgactgtgagacccacaagtcgatcaggtgcgaaagcaggacatagtgatccggtggttccgtatggaagggccatcgctcataggataaaaggtactccggggataacaggctagtctcccccaagagctcacatcgacggggaggttcggcacctcgatgtcggctcgtcacatcctggggctggagaaggtcccaagggttgggctgttcgcccattaaagtggcacgcgagctgggttcagaacgtcgtgagacagttcggtctctatctattgcgggcgttagatgtttgagagggcttgattctagtacgagaggaccgaattgaacaaacctctggtgtatcagttgtaccgccaggtgcaccgctgagtagctacgtttggaagagataagcactgaaagcatataagtgcgaaactcgcctcaagatgagacatcttttaagggtcgttgtagatgacgacgttgataggctacaggtgtaaagacagtaatgtcatagccgagtagtactaattacccgtagatttatagtctatggttactgtatcaatcatataaaatgacaagtactttatgcgcagtaaaggttttgtctttgtgaaagtttttatcgcttaaaaacgcagatggcggatagcagttagcgaatggcaataaagccaatagccagcagccaatagccagatgctatataccttctttagggtggttttagcggtggggctcacctgttcccattccgaacacagaagttaagcccaccagcgccgatggtactgctaacgcgggagagtaggccgccgccagtttttattttatttttaaaaatcctttatcaaatgata

SEQ ID NO: 28 - DNA, 3271 bp, Chryseobacterium sp.
agctggctgcttatattacgggaagtactgatttaagcattgtctcacttcgtgactatttacgtggagttttacctgattatatggttcctggtcattatatccagctggaaagttttcctttgacatctaatggtaagctggatcgtaatagtttaccagatgcgtttggatcctctttaggatcggggagagaatatatagcggcgcgcacggctattgaatctgtcttggtggatgtctatgaaaatgttcttggtaagtctggagtaggaatccgggatgatttttttcttttgggaggcgattcaatcaagtgcatccagattgtatctcgtcttcgccagaggggatatagctgtgaagtaaaggatattttgcttaatccaatgatagaggatttggtaatttgtgttaaggctttaaataatataatagatcaaaggagtgttgtaggagatgttttattgggtcctatccagatggattttctaacgggaaattattctgctaaggatcatttttaccaatcagtattgttaaaaagccgtgattcactggaccttgcattattagaacgtacccttcattcactcttggttcatcatgatgctcttcgtatggattaccgttttgaagacggagagtggcatcagtttaatcgtgatatttctgctatatctttagaagttctggagttttgggttagtgatgatgaatctttttctcaggcgtgccgtcaagttcagtcttgtattcgtatagaaggcggtagccttgtgaaggccggtttgctgagagcatctgatggggattatctttatttatcgattcatcaccttgtagttgatggcgtttcctggcgcattttatttgaagaccttgcaagcttgtacattggttatcaaaaaggattagaatttgtagagcttccattaaagactgattcttatcagcattggagtgctaagctgcatgaatatggagaaagtgaagtactttccaaggagcgtatgtactgggattctgttttaagagcaccagtttctggtctccctgttgattatcctttagggagtaaaaggaatggtgatacccgtatttttagttttagtttggataaagaagctacgactcttttacagacggaatgtttccgtgcgtataagacgagtctcaatgatatactattatcttgtctgagttacagtttaggagcatattttggattggatggagtttgctttaagatggagggtcatggtcgtgaggttataggatcaggagttgatatcagccgtacagtgggttggtttaccagtgtttatcctttggtcatttctttttcagaaggagaaagtttgttagatcatctgattggtgttaaggagatcgttcaccgtgttccccataagggtattggttatggtatcttgaaacatataaaaggtttggattatgaattgaggggggatgttctgtttaattaccttggtgattttggttcgggattacatgaagaaggtggagatcatatatttgatttttcgcgccgtttatcagggaatgatcagagtcttgatgaagaccgcgacagtgttttggagatctcggggatgatcgtagggggtgagcttcagctgggaatatcatatagctgtggtcaatatgattcttctacgatagaaggtttgggttctttttatgaaacatctcttttggacttgatagatatattatcaaaagaacaagcacaatatcttacccctgttgatcttacctataaaggattaagtgtttctcaggttatggatttgaatgcttctggtgatttagaggatgtgtatgctttggcccctcttcagcagggattattctaccattggttgtcttctccagaagactccgtgtattttatccagatgagttaccgtttatccggtgatctggatgttgttttattaaaggagagttatgttcacttgatagctcgttactcagttctacgtacagttttcagtgatgagttgagtgatatagggcttcagatagtaagaaagaggggagttgcagattttagttatgttgaagttccttttggttctgatgcaggttcttttatccgtgaatataaatcatcagatattaggaggggttttgatttactatctcagagtcctatgcgtttatcgatattgaaggcaggagaatcagagtatgaatttatctggagtatgcaccatatccttatggatggttggtgtctgggtatattaataggagagcttcttcatatttataatgccttgaagaatgggttatccccgaggttaaagcctgttcatgcttatggcagttatttatcatggctagagagtgttgatcatgaagatagtcttaattactggcgagattatttatcaggttatggagggatgtctggtcttcctgtgggagttggggttctggagcctgatactgttattgaggagctagactttacgcttgatatttctacaagtgatcgtttacgagaagtatgtactactcttggagttacggagaatacatttttgcaatgtgtgtggggtgttttattagggaaatataacggaggcttggaaacggatgtagtttttggcgcagtagtttctggccgtcccggctctcttgaaggcattgaggatatggtagggttgtttatcaatacgatccctgttcgtgtcagaggatcggcggatacgttgttttcaaaagctgttctaaagcttcattttgagagtatttcttccacgggttatcactacagccagctagcggatattcagaatgagagtggtttgggtaaggatttgtttgatcatattttgatttatgagaattatcctgttcaggatatggtgggtcaggagatgaatgatgcttctgaactaaggatacttgatacacataatgtagaacagaccaattatgatttaacagttgttattgttccaggggttaatcacagtttcaaattcagctataatcctcgtgtatacagtaaagagatcatgtcccagcttaagggtcatctcttacatcttatttcagttttggtatccaaccctgaacagccattaagttctttagatatggtaacaaaagaagaacatcatcttttgaccgaagggtttaaccagacggatgctgcttatccccaggataagacggtgatcgatctttttgaatcacaggtgttattgactcctggtaatacagcgttaatttt

SEQ ID NO: 29 - DNA, 2608 bp, Chryseobacterium sp.
tctgggaggatgttttaggaaaatcaggaataggggttcttgataatttctttgagttaggaggtcacagtttgaaggccgcccgtttgtcagcattaattcataaggagtttaatgttaagattcaattgcaggatatatttaatgaatttacaattgaaaaacaaggattattgcttggagttagagattcagacaaatatatttctatatccaaagctccagaattagaacactatcctttatcttcttctcaacgccgattatggatattgagtcgttttgaaggagcaaataaggcttacaatatgcctgaggtttttagaatttcaggtgatcttgatatgaatgctttacagcaggcttattttaccttattatccagacacgaaattcttagaacagttttttatgaatcagctgatggtgaagcctatcaacgtattctttctattaatcaggctgatagcttccaacaccacattattgattttgaatcagacaatattcttcaatctattatttctcaagaagtaaaccacatttttgatttatcagaggggcctttgattcgtcttactattgttgaaaatagctcagattcgcaatatgttttctgtctggttatgcatcatattatcagcgatggatggtcgatggaggtattaagaaaggaacttttttctttttatagtaattttactaaaaagcaaaatagagaatttccttctcttcgtttacaatataaagattatgcattctgggagcagtcagggcttgaaaccagaagtttaatttccaaaacttattggcaggagcaattatcaggagacttacctgtccttaatttaccttctaaaggaattcgtccttctgtaaaaacctataatggagagtatttttatggtaacttttccaatgaagttctttctggtttaaaggaaatatctcttagtactggaagttcattttttatgattgttttatcagctgttaaagttttattataccgttacagcggtcagaaagatcttattataggaactcctgttgccggacgtgaacatgctgaacttcaggatcagattggtttttatgtcaatacactagcccttcgtagtcatattaagggagatgaacgttttatagatttcctgtcggaagtccgtaagatgaccctttctggatatacccaccaatcctatccatttgaccgcttgattgaagatttagatattgttcgtgatatgagtcgtaatcccgtatttgatgttatggtgaatcttcaagactctgaggaaaaaaatatatcagatgatttttcggaaaagatttttgttaactcttataatggaacgtcatacaatgtaagtaaatttgatttagactttagctttgtggagaatagttctggattatcagtaggtttgtgttataatactgatatttatgatagaagtttagcggagcaattgatgaaaagtttagagcttttattaatatctattaatgaatcatcagaaacgattattgatgaactgaatattttaccggaagaagaacatcatcttttgaccgaagggtttaaccagacggatgctgcttatccccaggataagacggtgatcgatctttttgaatcacaggtgttattgactcctggtaatacagcgttaatttttgaagggatatccctgagttatcgagagcttgatgagcgttccaaccaatttgcccattatcttcgcagcgagtataatatagggagggaagatttggtaggcgtacagctggaaagatcttctgattttgttattacgattttagggattttaaaagctggcggagcttatgttccgatagatccttcttatccatcggatcgtattgcttacatgaaagaagacagtgggtgtaaagtagttgtagatattgaagaacttttattgttcaaaatggaaatggatgattattctgttttgcctgttgagcataaaagccagcctgatgatttagcgtatgttatttacacttctggctctacagggcgtcctaaaggagttatgattgagaacaaaagcttaatgaattacctgttctggggaatggattattatcctcctggagatttcagtatttttacatcaacgtcatttgacttaacgtatacagggatgtttttacctctgattaccggatatagtgttactattgagggtaataatttaataggaatagaagaaggtcacgaccttaattttgacagtataaaaattacaccttctcattttgaagtattgggagaaaagcttagaaccaatacattaattttagggggggagaaactgattgttgatcagattaataatttttttgataataataaaaatgctcatatttataatgaatatggtcccactgaagctactataggctgtacaatctatcatttagattcatcccatgattgccattctatagttccaataggccgtccaatttctaatactcagatttatattttgtcagaaggaggatcattgtgtccggtgggagttgtaggagagctttacatttctggctcaggtttgtccagagggtatttgaa

SEQ ID NO: 30 - DNA, 2357 bp, Chryseobacterium sp.
tgaaatacgaaatacagcaggtatattataagctcctgaagatcccgaaaaattactcataagccataagcgacgttgggatgaggataatgggtaagaatctaaaataggtgcactgggaatagaataataagatgattctttcaaaaatttcaaaatattatttttattttcttttattttacccgagaacaatctcattttttcttcatcgtcataagatacttttaaatcatcacctattaatgttatatctattgtatttctttttaatgaaagtaaaaaagatttgatgtcattcattttcttacagactttttactatataaaatttccttctcaccatatagcctttctgctataattcctttattgttacaggtttcaactaataaatttgactgtacaataggatttgattcatccgtatattttatactacttataaactcacaccatggctcttgtcccatggcatatacataaacttctaatgggttaaaaacatcaaccaggtccatacctttcttaaaatcggaaccagataatcttcttgactgatcatgctccctactgatttcactaagcattaaagggccatataaccaagttaaaggtgctccatcacactccattcccaaaaatataacatctacctccccgatataattttttacatgttcatatgttcttttttctaaaacacgagaatcagctaaaaacattaatgtaaactcatctacttttatatggtaacatgtttttgacggaatatccaggtcactatgttcccccataaatggaatacctgttatttggcaatcattgaaattaactgactctaaatcacctatttcaattacattttcaaatcctatattgttaaacattaattttacattaggatcctgtatacttccatttcctgatcttggaacaattatatttttaattttatgtcttaaaggaaggagtgtctccaataaaatatgatcctgatgattatgagtaataagtacataatcaataacctccggcaaatcatagtcagaaaaatgttcaacgcttgaggtatatccataatagctaataagaggatccacaagtacacttacagtatctgtttcaattagaatacaagcatgtccaaaataacgcatacgaactttatctcccttatattccttataaggagttgctgcttcttgtgtaaaaaagctttgaaataataattcttctttttctgtgagatttcctattaaacttcttatttcctcatagcttttgggggttcttttcatcttactgatttcatcaataaaaggatgatcaaatggtaaatttaaatgtaatactccttcttcatttaatcttggtgtacttaaacaaaaaggacgagaatcattctctgtgacccatagtgctatactttgtgtattggttgtgtaaaagttacttttatataaaaggttttcaaaaaatctaaaagacggatttccgttaaggtcatatacaagttctatatatcctttcagtatctcgggaactttagggtaaatgtcttccaatgactgtccttttgcttctttctgcaaaatttcatttaatttttttatagccaatgatagttttataacctctctttgatcaatcattgtcttcccaagcaattctctaatgtcctgaactctgttggtcttataatccataaaggggcctcctaacatctttggattctttaccatattttcatgttcctcggaagattctatataggaattcattattttcatatgtctgtgcgtcacatttaaacctgctgtaaccggtgaaatgagatgagcccaagcataccatctttctattaaaggctctatcacaacattaggtttcaggtaatatttatttgtattcatgtttataagtctaaattataatttctgattttctattattatctttcaatatctctttatattcactaactactattgctaattcttctatattttttgtcgctaatatctcttgcaatgaaatttttatatcgaattctttttgaatcatcgatgacaatcgtgttgctttcaaactgtgaccgcctaattcaaagaaattatccaggattcctattcccgattttcctaaaacatcctcccagatagaaataattctagtttctgtctcattgcgagccgctacatataccttattaatacttagtaaagagccaaaagcatcaggtaaattcttacggtctaacttaccattagacgtcaaaggaaaactagccaactgaatataatgaccaggaatcatataatcaggtaaaacatcccgtaaataatcacgtaatt

SEQ ID NO: 31 - DNA, 2080 bp, Chryseobacterium sp.
aagatgagatctaagataatccacatctttactcttttcatgatttaacaccaaaataccaactccctgcaaaagaggataaaacaactcgaataaagaaatatcaaatgcatgggatgccaacaatggaaaatagcctgacaaagatcccccaaaaggaaatgaagagctaacatccaacagtaaatttgctaaactcccatgctccaccataactcctttgggctcacccgttgatccggaagtatagataatataagccaaatcacatggggaaggatggtcaccaattgctccggaagaataatcatcacgttccatattaaacaaaagatattcttctgcatttatattaactttgcagccactatcagaaagcatataagcaatacgctccgatggataagacgggtcaattggaacataagcacctcctgactttagaattcccaatagagcaataatcaatgagtcggacctttcaagctctacacctacaaggtctgcccttcctatattatactggctccgaaggtaatgggcaaactggttggaacgctcattaagctcctgataactaagctccatgccttcaaaaaccaaagctgtacggcctggtgttagtaatacctgggactcaaaaagatcaatcacggtcttaccttttggataaacagcatgcgtctggttgaaaccttgcgtaagaagatagtgatcttcagatcccaaaatatccaatttattaatagtcaactccggagtatgaccgatagaaaccaacaagagctccaaactattgagtaagcgctctacaaatgatatatcataaatatctgtgttatagcctaaacctatagagaggcctgaggcattctccgaaaaactaaaatcaagatcaaatttactaactgcataaccggaagcattatacggctccagaatcaaaccatccaaacctacggaattagatgcattatccccggaaacagattcctgaaaacttaccataacatcaaaaacaggatgacggcttaaatcacggacaatatcaagatcttcaaccaaacgatcaaaaggatatgattggtggttatacccaagtaaagtagtctcacgaacagaggaaagaaaatctataaaccgatcttcgccataaatagagctgcgaagagctaacgtattcacataaaatcctatctgagcctcaagatcagcatgttctctaccggctacaggggtccctattattaaatctttctgaccactgtaacgatataataataccttaacagcagataaaacagtcatgaaaagagtgctcccattagtaagagaaattgctttcaataatgaaagtgtatcaacagagacaaaacccgaaacatgagaactgttataggttttaaccgcaggacgagctccttttgagggtaaagcaagaacaggaagttctccggaaaactgagcccgccaataatctttggacaatgaacttctaatttcaagttctgaccgctcccagaaggcataatccttatattggagacctaatggtggtaagaccgcaggattgccagatttaaaatgattatataaggtaaacaactctttttgcaatatatccatagaccagccatcactaatgatatgatgcatcacaagacagaaaatatatccatcgccactgcgatcttcaataagcgtaagacgaatcaacggaccggatgttaattcaaatacacgaccagtctcttgagaaataacttcttcaataacctgcttttcagatacaaaatctaaaagaaaataagaaaaactatccggttgggcctcaggtaaaactacctgacagcccaatccatcaatagtctcccgaaaaacagtcctcagaatttcatgacgagacaataaggaaaaataagactgcttcaataagtttatatccaaatcacctgaaatacgaaatacagcaggtatattataagctcctgaagatcccgaaaaattactcataagccataagcgacgttgggatgaggataatgggtaagaatctaaaataggtgcactgggaatagaa

SEQ ID NO: 32 - DNA, 1571 bp, Chryseobacterium sp.
taataccttggctcttcggagtcatattgacgggagttctagttttgttgatttcctgttaaaggtgcgtgatatgaccttatcgggttatgctcatcagtcttatccttttgaccgtttggttgaagatctagatatcgttcgtgatatgagccgtaatcctgtttttgatgtgatgcttaattttcaggatcttgaaagcggtaatattgataattctggagatctttctcaagggatgtcgagccattcttatgaaggggtttcatatgctgtgagcaaatttgatttggattttagtttttcagataacggttccggctttacgattggcttgtgttataatacagatctttatgatcggatttttgctgatcgtttgatgaaaagtttagagcttttgtttatttcgatcagtgaatcatcagaaacgattattgatgagttgaatattttacctcaagaggagcattaccttttgacagaagggtttaaccggacggatgctgcttatccccaggataaaacagtgatcgatctttttgagtctcaggtgatattaagccctgataatacagcgttaatttttgaagggatatccctgagttatcgagagcttgatgaacgttccaaccagtttgcgcattatcttcgcagcgagtataatatagggagggaagacttggtaggcgtacagctggaaagatcttctgatctcctgattacgattttagggattttaaaatctggtggtgcttatgttccgatagattcatcttatccctcggatcgtatagcttatatgaaagaagacagtggatgtaaggtagttgttaattcagaggaacttttgttattccatatggagatgtctgattattctgttttgcctgttgggcatagaagtcagcctaatgatttagcgtatgttatttacacctctggttctacaggccgtcccaaaggggttatggtagagcatggcggtcttgttaaccgcttggcttggatgcagggagcctatagtttatcaccttccgatacgcttatccagaagacgaattattcttttgatgtatcggtttgggagcttttatggtggagtctgtatggttcgaaactttgtattctgccagtaggagcagagaaatcacctgagttgttgatttcgaacatttcttttagtgaagtcagtgtgatccattttgtaccttcaatgctggagagttttttagattatttatctgttcatcctgaagaattgtataagctgaagagcttgaaacaggtttttgtaagcggcgaggccttgacgacttaccagaaccgtgagtttttcaggttgcttccggatgtaaagctgatgaatttatatggtcccacagaagcaacgatcgatgtcagctattttgaatgctgtgcagatcttgagggaagtattcctataggctttcctatatctaatacacgtatgtatatcttgtcggatgggggtagtttatgtcctttaggagtagtaggagagatctgtatttctggggtgggagttgcacggggatatttaaacaatg

SEQ ID NO: 33 - DNA, 1332 bp, Chryseobacterium sp.
gctttagattctgtgttaacttccaaatattttttatacatttatatttataaaagcgaccttgagttagcttgcgtagggtgaaggtctttgatttttaccctactttcttcaaaatctgtctggtaaaaagttttatttttaaatagaatatacatcagttccaaaagttttctttgtacagcaaccagccccttcattttaattcctgttttttctgtaatcctttgaaacaaatcctgatggtttttattcatttttacggctgtcattgcaggaaaatgtaatgtttttcgaatatttttatttcctttcttactaattcttggcttaccttttattgatgttccggactgtttctcgcggatatcaagtcctgcataacttaccagttgttttttatttctgattagctcaaaaccattggtttcagctaaaacagcaattgccgttgattttccaatacccggaatactgctcaacagattaactcccctggtagcctcaggacttttctttacctgtgcaaccatatcctcattaatttctttctcctgttttttcaataacgaaatacgctcggtcagccgttttatggttcttgaattgggcagggcctgagtcttttcagcatgcagctgattcatacaccttaccctttcctgaataacctggtttttctcgcggcttagctgctgaagttctttatacacaatgtttgcgggttgccataattctagttttctgcttaaaccaaactgtgtaatagctatggagcagcttttatcggtaatagttttgatatccagggtcctgatgaaattactgatcttattagggagcataatgactgttttttcttcctttgcataaataaaatgagcaaatctttcatgatatactcctgtagcctccatgacaaaaataacgtccatattaagtgtctttttgctgtatacccatttgagaagtgattcaaagcctttttcgctgttgctaaaaactttataatctttgatttctgtacttagatcttccattaatctgccaaaacttgccaccagttcatctttggctacatctattcctacaacctgttttaatacgttcatatttttattttaaataaaagcaagccttccttcgttttgtctcctgattattatccaagatatcttttccgatcctttaaattctgtccaaactctaaaaggaataaagaagtgaggacatttctaaagcacaatatacttcctgagttatttagccaaaactgttctctcaccccttttgctttgtatgtaaatttattcttttgcaaacataggagcc

SEQ ID NO: 34 - DNA, 1308 bp, Chryseobacterium sp.
tgtctcgtcctgaaataagttgacaactaatcgacttatttatgaaagatcaagtattaaaaagagaaaagcgcacacaaaaagactacagtatagcctttaaattaagaatagtttctcaagtagaaaacggcgattacacttacaagcaggctcaaaaagagtatggtatccagggaagaagtactgttttggtttggttgcgaagatatggtaacttagagtggagtaaacctaaacttcatactatgtctaattccaaagaaacaccagctcaaaaaattaaacgtttagaaaaagaattagctgatgaaaagctaaaaaccaaggttcttaatacgatgattgatatctcagataaacaatatgggactcaaatcagaaaaaagttttcctcccaacaatcttccaactccatagacaaggaataagtatatcaagactgtgtagattgtttgggataagccgtcaagctatttatcaagctaagcaaaggattttaatccgggaaaaccaattactgaaagtaaaatttctggttcaggaaatacgaatgaagttacctaaattaggaacaagaaaactttatcatcttcttaaagaacagctcatacaggaagatgtcaaattgggaagagatgctttatttgcctacttaaaaagagaaaatatgctaatccgtagacaaaagaaatatattaaaacaacattttcaaagcattggcttagaaagcatcccaatctgttgaaggatttgaaaatagagaaagcggaacaggtgtttgtaagcgatataacttatcttaaaaccaaagaatctacatgttatttatctttggtaacagatgcctatagtagaaagatcatgggatattcattaagttcaaatatgaacactgaaaatgttgcgaaagctttaaaaatggcaataaaaaatagaggttcaagtggcccattaattcatcattcagatagaggtttgcaatattgctctggttattaccagaaaatacttaataagaatgaaatcaaaccgtcaatgactgatggttatgattgctatcaaaatgcactggcagaaagggtgaatggaatattgaaacaagaattccttttttataaaacaaagaatatgcaagatctaaactcattagtaaaagaaagtatttatctttataatactaaaagaccacatctaagccttaatatgcaaactccagataaagtgcataaaaaatccgaagaaataaaatatctctccggattaaatattgtttaatttatgtcaacctattttaggacgactca

SEQ ID NO: 35 - DNA, 1039 bp, Chryseobacterium sp.
attatatggttcctggtcattatatccagctggaaagttttcctttgacatctaatggtaagctggatcgtaatagtttaccagatgcgtttggatcctctttaggatcggggagagaatatatagcagcgcgtaatgaaacagaatcccttcttgtagagatttgggaagatattttaggagtagcacatattggggttctggacaatttctttgagttaggaggacatagtttgaaagctgctcgtttatcaacactgattcaccagaagcttgatgtaaagatctccttgcaggatgtatttacagagcctacaatagaaaaacaaagcttgttgataaataatattaaaattattagcagagaaacatcatctacaattacaaaaaatagaataaagatatagttattaataaatttattaataataaaatagccggtattacattgatttaacagaagatagataagagatgaaaaaattattagaaagattagaatccttaaatattaaaatagctcttgaagaaggagaattatacttagattcagatgaattaatatcagatagtttaatacaagaagtaaaggataacaaaagggaattaatagagtttataaaaagattttcttcctctgctattttgtataataatattcctttagctccttttttagaggggtatccattatcctcttctcagcgccgattatggatactgagtcgttttgagggagcagacggagcgtataatatacctgaagttttccgtgtttcagggggagttgatatagagtcattgaagcagtcttattttacgttgttatcgcggcatgagattttgaggactgttttccgagaaaatgaagagggagaagtatttcagcatattctttcagatgtttttgaggatagttttgagtatttgaagctggattttacgaaagaagagggtaaaatttccgaaatcattagtttcgaaacaaatcggatatttgatttatccgaaggtccattgattcgttttacagttcttg

SEQ ID NO: 36 - DNA, 881 bp, Chryseobacterium sp.
aaataataccaattctaaacaaatggttccagaatattgaagaggagggtatagtttccactcattcttttttttcctttatcaaatttatttatgtatttacttatttatttttgatttatttatttttttaattatactttaagttctagggtacatgtgcacaatgtgcaggttcgttacatacatatacatgtgccatgttggtgtgctgtacctgttaactcgtcatttacattaggtatatctcctaatgctatccctcccccctccccccatcccacaacaggccctggtgtgtgatgttccccaccctgtgtccaagtgttctcattgttcaattcacacctatgagtgagaacatgaggtgtttggtttttctgtcctggcaatagtttgctcagaatgatggtttccagcttcatccatgtccctacaaaggacatgaactcatccttttttatggctgcatagtattccatggtgtttgtgtgccacattttctgaatccagtctatcattgttggacatttgggttggttccaagtctttgctattgtgaattagtgcctcaataaacatacgtgtgcatgtgtctttacagcagcatgatttatagtcgtttgggtatatacccagtaatgggatggctgggtcaaatggtatttctagttctagatccctgaggaatcgccacactgacttccacaatggttgaactagtttacagtcccaccaacagtgtaaaagtgctcttatttctccacatcctctccagcacctgttgtttcctgactttttaatgattgccattctaactggtgtgagatggtatctcattgtggttttgatttgcatttctctgatggccagtgatgata

SEQ ID NO: 37 - DNA, 868 bp, Chryseobacterium sp.
ttcaaataccctctggacaaacctgagccagaaatgtaaagctctcctacaactcccaccggacacaatgatcctccttctgacaaaatataaatctgagtattagaaattggacggcctattggaatgttagaatattccttatctactttgaatgaagtggccaccactgtattttcggtaggaccataattattgtaagtcttaaaaccttttttattatagtaatttaatttatctcctcctgttaaaacttttgataatgattgattatccatgtgatagaactgttcacatataaccgtaggtaaaaacgtaatgttaattttctgatcttcaatataattatttaatccaacaagatccgttcttagagtttcatttaataaatgaattgttcctccttttatcagataaggaaacagctcccagacagacgcatcaaaactaaaacttgagtataaagctgaacggcttttttctgtaatatcaaacgtttctatattccaatacaataaattgacaaggtttctatgttctaccataactcctttgggacgccctgtagaacccgaagtgtaaataacatacgctaaatcattcatttttgtatcatgaataggtgcagcacgtgaatataaggaatagctcatattaaataatgacaattcatccgaatcaacaacaaccttacatccactgtcttctttcatgtaagctatacgatccgagggataagatggatctatcggaacataagctccgccagcttttaaaatccctaaaatcgtaataacaaaatcagaagatctttccagctgtacgcctaccaaatcttccctccctatattatactcgctgcgaagat

SEQ ID NO: 38 - DNA, 878 bp, Chryseobacterium sp.
tctgggaggatgttttaggaaaatcaggaataggggttcttgataatttctttgagttaggaggtcacagtttgaaggccgcccgtttgtcagcattaattcataaggagtttaatgttaagattcagttgcaggatatatttaatgaattgaacaatattgagttaatctcccaatatcttatcaaagaacaaagtaagaaaaagtggttagagttgaatttatccaatagcggagaggatgatgttgttgatgaagtatttttataaaacttatctaatttatggaagaattatttgaactcttatacaaagagtctatatatataaaattaatagatgataaattatctgttaaaagtaataaaggaaaaataagaaaagaaattattgataagatatcattacatcgggaagagattatttctttcctgatgtctaatatttcatattctcatattcccatagctcctttcttagagggatatcctttatcttcttcccagcgtagattatggatactgagtcgttttgaaggagcagacggagcgtataatatacctgaagttttccgtgtttcaggggaagttgatatagagtcattgaagcggtcttattttacgttgttatcgcggcatgagattttgaggactgttttccgagaaaatgaagagggagaagtattccagcatattctttcagatgtttttgaagatagttttgagtatttgaagctggattttacgaaagaagagggtaaaatttccgaaatcattagtttcgaaacaaatcggatatttgatttatccgaaggtccattgattcgttttacagttcttgaagatgtatcagggagtggctatattttctgtcttcttg

SEQ ID NO: 39 - DNA, 765 bp, Chryseobacterium sp.
gatagttttgagtatttgaagctggattttacgaaagaagagggtaaaatttccgaaatcattagtttcgaaacaaatcggatatttgatttatccgaaggtccattgattcgttttacagttcttgaagatgtatcagggagtggctatattttctgtcttgtaatgcaccatattatcagtgacggctggtctatggatatattgaaaaaagaactatttacattataccgtggttttaaagaagctgatcctgttgtattgcctcctttagcattgcagtataaggattatgctttttgggagcagtcagagctagaaacaaagagttcattgtccaaggcttattggcaggaacagttatcaggagacttgcctgtgctcaatttaccttccaaaggggttcgtccttctgtgaaaacttaccatggggaaaatatttacggatttatatctgaaggaaccctttcagaattaaagagaatatcgttaaaaacaggctgtactcttttcatgactgtattatcagctgtaaaggtgttattgtatcgttacagcgggcagagtgatctgatcatcggtacgccagtggcgggtcgcgatcatgctgatcttcatgatcagattggcttttatgttaataccttggctcttcggagtcatattgacgggagttctagttttgttgatttcctgttaaaggtgcgtgatatgaccttatcgggttatgctcatcagtcttatccttttgaccgtttggttgaa

SEQ ID NO: 40 - DNA, 753 bp, Chryseobacterium sp.
cttcggataaatcaaatatccgatttgtttcgaaactaatgatttcggaaattttaccctcttctttcgtaaaatccagcttcaaatactcaaaactatcttcaaaaacatctgaaagaatatgctgaaatacttctccctcttcattttctcggaaaacagtcctcaaaatctcatgccgcgataacaacgtaaaataagactgcttcaatgactctatatcaacttcccctgaaacacggaaaacttcaggtatattatacgctctgtctgctccctcaaaacgattcagtatccataatctacgttgggaagaggataatggatacccctctaaaaaaggagctaaaggaatatgagaatatgaaatattagatatcaggaaagagatgatttcctcccgatgcaatgatattttttcggataattctctattcagaatttccttagctgctagaatttttaattttccttcttctacatacgcagaagctccatttttctttagaaaatttaagattgaataaacttcctttttaatcatatatttttatttttaaaaaataaatacctctctatcatcagagccatcctccactatattatttttaattgaatgtgcttcaatcaacaagctttgtttttctattgtaggctctgtaaatacatcctgcaaggagatctttacatcaagcttctggtgaatcagtgttgataaacgagcagctttcaaactatgtcctcctaactcaa

SEQ ID NO: 41 - DNA, 694 bp, Chryseobacterium sp.
cagaaggagagagtctttgtcctgtaggagtatcaggtgagatttgtatctccggctctggcttggcaagggggtatttaaacaaagaatccttaaccagtgagaagtttgttattaatccttattccggtgagaggatgtataagacaggcgatttggggcgttgggattcagagggaaacatagagtttttagggcgtaaggataatcaggtaaagattcgtggttatcgtatcgaattaggagagatcgagtctactcttcaggggcatgaaggagttacagggagtgtcgttttggctgttgagaatgaagaagggcagaaagagcttgctgcttatattaccggaacaggtgctttgactggctcagaattacgggattatttacgaggtactttacctgattatatggttcctggtcattatctgcagctggatagttttccattaaccagtaatggtaaacttgaccgtagtaatttgcctgatgtttttagtatttctttaggctcaggagttgaatatgtagcggcgcgtaatgaaaccgagaagaagctggtttctatctgggaggatgttttaggaaaatcaggaataggggttcttgataatttctttgagttaggaggtcacagtttgaaggccgcccgtttgtcagcattaattcataaggagtttaatgttaagattca

SEQ ID NO: 42 - DNA, 683 bp, Chryseobacterium sp.
atctctcctactactcctaaaggacataaactacccccatccgacaagatatacatacgtgtattagatataggaaagcctatgggaatagatctgcgccagctgtcttcttcggaaagacgataaatactgctgcacacggaacattcagtaggaccatacgcattaaaataggataagctgccacataacgaaagtcctttttctatggatgacgattcacccgcagaaataagaacacgcaatccggataaatcttccaatgacagcatttctgaatagacaggtggaagagtgataacactcgtgcccgaagattttaatatctcaacaaacttattcttatccttaagaacatcatcttcgcaaatgaaaagactagacccgcttaacaaagacatcattacctctgaaaaagaagcatcaaaagcaatagaagcaaagaagaaaacaacatcactgcttactactccaaattcacggatctggctcaataccatattcaacactcctccatgctctaccataacccctttaggacgcccggtagagccagaagtgtaaataacatacaccaggtcattcgggtggattatatgcttaacgggcagaacaggatatctctgctgctgatctttaaataacaataattcctctgaatcaacaactaccttacacccact

SEQ ID NO: 43 - DNA, 721 bp, Chryseobacterium sp.
cagcttcaaatactcaaaactatcttcaaaaacatctgaaagaatatgctggaatacttctccctcttcattttctcggaaaacagtcctcaaaatctcatgccgcgataacaacgtaaaataagactgcttcaatgactctatatccatatcacccgagagtttaaatattgctggtatattatacgcatttgctgctccctcaaaacgactcagtatccataatcggcgctgagaagaagataaaggataagagtccaaatccggagctcgtgaaatagaaatatattcgtctgagttactaactcctagtaataatccctgtttctcaatggtagactcgctaaagatatcctgcagcgaaatcttaacattaaactcctgatgaattaaggcagataaacgcgcggcctttaaactgtgaccccctaaatcaaagaaattatctttaatgccgattcccgatttccccaaaacagcctcccagatagaaaccaacttctcctctgtttcattacgcgctgctatatattcaactcctgagtctaaggaaactccaaaagcatcaggtaaattcttacggtctaacttaccattagacgtcaaaggaaaactagccaactgaatataatgaccaggaatcatataatcaggtaaaacatcccgtaaataatcacgtaattctgagccagtcaactcccgcgttcctgtaattctaatt

SEQ ID NO: 44 - DNA, 625 bp, Chryseobacterium sp.
ttcatcaagctctcgataactcagggatatcccttcaaaaattaacgctgtattatcagggcttaatatcacctgagactcaaaaagatcgatcactgttttatcctggggataagcagcatccgtctggttaaacccttcggtcaaaagataatgttcttcttgcggtaaaatattcaactcatcaataatcatttctgatgattcattaatagatattaacaaaagctctaagcttttcattaaacgctccgctaaacttctatcataaatatcagtattataacataaacctattgataatcctgaactggtctccacaaaactaaaatctaaatcgaatttgctggaaacatgatttgattccatatatgaatctatagtaactccatgtaaaaaatcctcttgattttttttattttcagaaattaatttttgtagacttaatacaatatcaaaaacaggattacggctcatatcacgaacgatatctagattttcaaccaaacggtcaaaaggataagactgatgagcataacccgataaggtcatatcacgcacctttaacaggaaatcaacaaaactagaactcccgtcaatatgactccgaagagccaaggtatta

SEQ ID NO: 45 - DNA, 608 bp, Chryseobacterium sp.
gcgtgatatgaccttatcgggttatgctcatcagtcttatccttttgaccgtttggttgaagatctagatatcgttcgtgatatgagccgtaatcctgtttttgatgtgatgcttaattttcaggattccggggatgcaggagagggattatctgttttttcagaaaattcttctttcagctcttataccggttctgactatacgattagcaaattcgatttggattttaacttttcagagaatgggtcaggtttaggtattggtttgtgttataatacagatctttatgaccggatttttgctgatcgtttgatgaaaagtttagagcttttgtttatttcgatcagtgaatcatcagaaacgattattgatgaactgaatattttacctcaagaggagcattaccttttgaccgaagggtttaaccggacggatgctgcttatccccaggataaaacagtgatcgatctttttgagtcccaggtgatattaagccctgataatacagcgttaatttttgaagggatatccctgagttatcgagagcttgatgaacgttccaaccagtttgcgcattatcttcgcagcgagtataatatagggaggg

SEQ ID NO: 46 - DNA, 558 bp, Chryseobacterium sp.
attgttggcatcccatgcatttgatatttctttattcgagttgttttatcctcttttgcagggagttggtattttggtgttaaatcatgaaaagagtaaagatgtggattatcttagatctcatcttggagagatgaattctttacacactgttccagctttaatgagcgagcttttgtctcagattaaatcttcggattctgctgaaaattattcacatatagaatatattttcataggaggagataaggttcctacgcatgttttgcatgatatccgcagtgtttttaggaaagcaaaaatagttacactttatggccctacggaatgtacgatctttttattgacccgcagttatacaaactctgtagaagaatttaacggatcattattaggtcgtcctatctccaatactcaggtttatattctggcagaaggagagagtctttgtcctgtaggagtatcaggtgagatttgtatctccggctctggcttggcaagggggtatttaaacaaagaatccttaaccagtgagaagtttgttattaatccttattc

SEQ ID NO: 47 - DNA, 576 bp, Chryseobacterium sp.
attgttggcatcccatgcatttgatatttctttattcgagttgttttatcctcttttgcagggagttggtattttggtgttaaatcatgaaaagagtaaagatgtggattatcttagatctcatcttagagagatgaattctttacacactgttccagctttaatgagcgagcttttgtctcagattaaatcttcggattctgctgaaaattattcacatatagaatatattttcataggaggagataatgttcctacgcatgttttgcatgatatccgcagtgtttttaggaaagcaaaaatagttacactttatggtcctacggaatgtacgatctttttattgacccgcagttatacaaactctgtagaagaatttaacggatcattattaggtcgtcctatctccaatactcaggtttatattctgtcagaaggagagagtctttgtcctgtaggagtatcaggtgagatttgtatctccggctctggcttggcaagggggtatttaaacaaagaatccttaaccagtgagaagtttgttattaatccttattccggtgagaggatttattc

SEQ ID NO: 48 - DNA, 550 bp, Chryseobacterium sp.
ttgcaactgccccaagtactttcattagtctggttatggtctcctgtatagcaagagaaatacatatctactgtttgataagaacaagattctacagtccccatactattagaaactactcctccgtatgttccttttgcaagttcaatagctgtggttttacctgctgtttttactccttttcctgcaagtaagtcaagtttttcctgtggcgtaaaagtgtaagttactaaaagttccttataagttccgtcaggtagcgaagataatactaaattttctaatggtgcattttcaggcgcattttctctaactaaattaaatgtgtaggtatggaaagtgggcccaacctcaatgtaagttacattgtctgtgtcaatcgaaactccattggcataatcaactgattttcctgatgcgttggttttgatttctgttagattgttttgtgctttttgtaattcagttttaagagctaatttgtgtttactttggtctaaacggattgttttggatgttggcctgaattggctgctgttgttgtaggttt

SEQ ID NO: 49 - DNA, 547 bp, Chryseobacterium sp.
ccaaaagcatcaggtaaattcttacggtctaacttaccattagacgtcaaaggaaaactagccaactgaatataatgaccaggaatcatataatcaggtaaaacatcccgtaaataatcacgtaattctgagccagtcaactcccgcgttcctgtaatataagcaacaagctctttctgaccttctttattttcaacggccaatacaacacttcctgtcacttcttcatgcccctgaagagtagactcgatctcgcccaattcgatacggtagcctcgaatcttaacctggctatcctttctaccgatatattcaatattaccatccgaaagccaacggcccaaatctcccgtcttatacatacgctcgcccggaagataaggattagaaacaaacttctctaaagtcaaatcagcacggttcaaataccctctggacaaacctgagccagaaatgtaaagctctcctacaactcccaccggacacaatgatcctccttctgacaaaatataaatctgagtattagaaattggacggcctattggaa

SEQ ID NO: 50 - DNA, 526 bp, Chryseobacterium sp.
gcacagctcgacatgggtggtctgcaacttgcgcttgaagtagcgcagggtttcaaaaaactcttccttaccgggcacccgcttggcgatattgaactggccgccaatctcgctggcggaatcgaacagcgtcacttgatgaccgcgctcagccgccacggtggccgccgccaggccggcaggaccggcaccgaccacagcgatcttcttgatctgtttcaccggcaggtagttgagttcggtctcgtagcacgcgcgcgggttgaccaggcaggtggtcaacttgccgccaaacgtatggtccaggcaggcctggttgcagccgatacaggtgttgatttcatccccacggccggcagcggccttgttgacgaactccgggtcggccaggaacggccgcgccatcgacaccatatcggcatcgccctcggcgaggatctgctcggcgatttccggggtgttgatgcggttggtggtgatcagcggaatcttcaccgagccgcgcagcttggcggtgactttactg

SEQ ID NO: 51 - DNA, 517 bp, Chryseobacterium sp.
gggacagtcacagtgccgacggtgtcgcccgccttgatggtgatagtcgagccgttatccaacttcagagtgacgtcggtgccggccttgttgctcaaggtcgcggtgtacgtaatctgaccaccttcgttaactgcgcttggcgcggtcagcgtgacagtggtggtatcggcggtgcctggtgtgtcagtcacagtggtggtgactttatcggtacctggcaccaggtcttcgaagggctcgccgccggtcacgccttggatagcggccgttacggtttgatcgcccttgtaggcatcatctggcgctacaaccgaaacggtaccgctcgactgattcacgccgatggtgatggtctggccgttatccaaggtcacggtcaacgggttggtgatgttagtcaccgcgttacccgccttgtcgaccagcgacgctgtgtagacgatattgccgccttcgcccacggtggtggtggcggtcagtacgacgtcgaccttgtcgatggtgtcgttgatcg

SEQ ID NO: 52 - DNA, 510 bp, Chryseobacterium sp.
tgtgtgttatcaatgagtgtattgtaattagggtgtcttgggtacaaggatagtaaaatgtgtactagtaaatatgagattgccactgttgaagtttcgtgttggtgttcgtgatttgctgggctttttttttttttttttcaggcagatgacggaatagggtttgggttattgggtctcgtgggctgggagatttgtataagggacagttttaaaagttcatacagtaaagatattttaggaaacgaatacagtgctattcttaaaaatatttttgcaataggcgcgggtattgcaagcgccgtctcttatacacctttgaccctgccgaagacgatgccgttgtgtaggtattgtgggtcaccgcaacaatgaaaaaaaaaaatgaatatgcaacactgagaaacggctatactaattaacatatacacacaaacaactgtctggagacctaaacatttaatctgatagtcgaaattagccattaagattacgcaagttgagacagtg

SEQ ID NO: 53 - DNA, 504 bp, Chryseobacterium sp.
gggtggcccagggcaatagctccgccgttggggttgacccgcgggtcgtcgtcggcgagccccaggtcccgcgtgcaggcgagtgcctgggcggcgaaggcctcgttgaactcgaagatgtcgatctcgtccatggtcacgccggtgcgctcgagcagcttgcgcaccgccggcaccgggccgtagcccatgatgcgcggctcgacgccggccgtggccatgccgatgatgcgggccatgggcttgaggccatgttgctcccccgcggcccggcttgccaccagcatggcggcggcgccgtcgttgacgccggaggcgttgccggcggtgatgctgccaccctcgcggaacggcgtcggcagcccggccagcttctccagggtggtctcgcgcgggtgctcgtcggtatcgaacaccagcggctcctgcttgcgccgggggatctcgatgggcgtgatctcgatggcgaagcgacccgccttctgcgcggcggcggccttctgc

SEQ ID NO: 54 - DNA, 496 bp, Chryseobacterium sp.
caggcacactgctgggccaggcgggcaacgccgcgacaaaagcgcgggtggttagcgttgcgccatatcacatcatagtgcatggccggtaacggcaccggtagcgagagacggtagagctccccccgctgccactcatccagcacggtagcgacaggcagcgcgccaatccccaacccttcggtggtcattcgtacaatggtcattaatgtgctgacgctatggatacggggattagcgattccctgctcggccaaataactcaccaactcggcatagggacgagcctgcttgccaaatgaaataaacggcaactgcttgccccaagtgtcggcactttcacccagctgcttgacgtggcgtggagagacaaacatgcccatttcataagggctcaaggactcgtactcgatctgcttttgcggtgaatagccattcatcgccaatacaatatccagttcgttgcccagtagccgctcattgagcactggcgagt

SEQ ID NO: 55 - DNA, 496 bp, Chryseobacterium sp.
ccacgtcgtcgggcgcgtcagatgggtgaaagtgacagttgccgagcagccgaagtggcgcttagccacctggcgtagcagcaggggcggcgcgtggtttacctcgtgatattcgagcgggtggtagagatagagtggggctttcgggcgcattgaagtatcctccgcgccccgctatcactgattcaaagaagcatgaccggacaagacctgcaggccctgctcgagtcgatcctcgacgaagttcgtccactgatcggccagggtaaagtcgccgactacattcccgcgctcgccgatgctgtctcttctactcatctccgagcccacgagaccaaataaccgaactcgtatgccgtattctgctggaaaaaataaaacatcatatgctagctgacaggcaaagatacattgtctctgaaacacagctcagagtctactagacacgtatgtgaatctcgtagtccgtcatcttcctgacgaaacaagactatcg

SEQ ID NO: 56 - DNA, 488 bp, Chryseobacterium sp.
tggttcctggtcattatatccagctggaaagttttcctttgacatctaatggtaagctggatcgtaatagtttaccagatgcgtttggatcctctttaggatcggggagagaatatatagcggcgcgtaatgaaacagaagagaaattaatttctatctgggaaaatgttttagggaaatcgggaataggaattaaagataatttctttgaattagggggacatagcttgaaagcagctcggctttcaacattaattcatcagacatttgatattaaaatttcagtacaggaaatatttaatgaatcgacaatagaaagacagagagcattattagataaaaaaggctgccaagaatacatttctattcccagtgcacctattttagattcttacccattatcctcatcccaacgtcgcttatggcttatgagtaatttttcgggatcttcaggagcttataatatacctgctgtatttcgtatttca

SEQ ID NO: 57 - DNA, 486 bp, Chryseobacterium sp.
ttttttctgtaatatcaaacgtttctatattccaatacaataaattgacaaggtttctatgttctaccataactcctttgggacgccctgtagaacccgaagtgtaaataacatacgctaaatcattgggttggcttctatgctcaacaggcaaaacaggatatctctgctgctgatctttaaataacaaaagttcctctgaatcaacaactaccttacatccactgtcttctttcatataagctatacgatccgatggataagatggatcaataggaacataagctccgccagcttttaaaatccctaaaatcgtaataataaaatcagaagatctttccagctgtacgcctaccaaatcttccctccctatattatactcgctgcgaagataatgcgcaaactggttggaacgttcatcaagctctcgataactcagggatatcccttcaaaaattaacgctgtattatcagggcttaatatca

SEQ ID NO: 58 - DNA, 476 bp, Chryseobacterium sp.
ctgttgaatgacattcctggacttgagtgccgtacacccgacggagctttttacgtatttgtagcctgtcaacagctattgggtagtcatacgccgaaaggacagcgtcttgaaacagatatggattttgcaatgtatctgctggaggaggctggcgtagccgtagtgccgggctcggggttcctggcggatggttttatccgcatttcctacgccgcttcagaagacgagttaacaaaagcttgcgccgcgattaacgaggctgtgcagaagctttctttagcccatgcttgaattcaaagagagcaatccgatgagaaatacaaataagtgccttcgcgacatcatctccagtggcggcatggcgagagtcatggccgcccatgatccgctttctgccatgctagtggaggaagccggttttgatggtatctgggcaagtggtttcgagctctctgcagcaatggggttggcag

SEQ ID NO: 59 - DNA, 463 bp, Chryseobacterium sp.
ttcctgcttagctaaaagcccttctgcgcttactgatctactctcgttttcagtggggcaaagatagtaacttcctacaacgcaaaacaagtttatttaacttaaattttaccgtttcgtaatatttactcttaaagcactggattgcagagagaaaaattttaaacatttgtttgaaatcttgcgttggagggccggagagtctgagagtttgagcgtgggagggtttaagggtggcagaaagagagaatggtgatacggggtgcggggttacagggtgtgaagtttaggagatggtaatatactatgatgatggtaatatactatataataaaagataagtttcggctcctatgtttgcaaaagaataaatttacatacaaagcaaaaggggtgagagaacagttttggctaaataactcaggaagtatattgtgctttagaaatgtcctcacttctttat

SEQ ID NO: 60 - DNA, 455 bp, Chryseobacterium sp.
cgtcactgatgccttgcgcgaaacagtgctcagcttccttcaaggtagaaaccgtgacaccgcgggcgccagcagccatctgtgccgtgatgacgggcaggcacttgctggttttgatgtgcgggcgcaaacgtacgccgagggtgtccatacgttgctgcatacgctggatattgcgctgcatttgcgcgacatcgactagcgcaaccggcgtgtcgagagaggcaatcggcgttgacatggcagaactcaagtggctgggtacaggctgcactctactcagctatcgttaacctgtggttcaatgagaaatcatcaatcattaagtaaaattgaatgatttccatcgaagacctgcgcctggcagttacgcttgcccgctctgagtcgctgagtgccgctgccagagccctgaatgtttcacctccggcgctttccatgcgcctgcgtaaact

SEQ ID NO: 61 - DNA, 449 bp, Chryseobacterium sp.
gccccaggcggtgctgttggtggagttcgccggtgaggagcggcagacccaactcgcctcgctcaaacgtctcaccgagctgatggccgacctgggcctgcccggcagcgtggtggagatgcccgagcccgtcgcacaggcggcgctgtggaacgtacgcaaggcctgcctcaacattatgatgagcatgaagggggacggtaagccggtctccttcatcgaggactgcgcggtgcccctcgaacatctggccgagtacaccgacaagttgaccgaggtgttccatcgccacggcaccgagggcacctggtacgcccacgccagcgtcggcacgctgcacgtgcggccgatcctcgacatgcggcggggcggggcgcacaagatgcgcgagatcgccgaggaggcttccgccctggtgcgccaatacaagggagcctactccggcgagc

SEQ ID NO: 62 - DNA, 436 bp, Chryseobacterium sp.
gggctatacagcatgccggcctggctgcggtactcctgggtgcgaatgtcttccgcccggaacagaaggaagcgatcgccgagatcggcctgtccctgattgcgccgggaaagcgcctcccaggcagtggggaatacggaagccaggcttctgccgaagcgcaacgggccttgcgcccccaccaacagccagttgccttgcgcatccaccaggagcggttgtgccgcatcgtcgatggccatggcctggagcaaactgcgggtcaggtattcccaatccaggctgaacaggagcacgcctttgcgttccccttcagtatcgaatacgggggttgcgatatcgaccacaggcactacattggcgccggctgtgtcgtcattgacgttttggccggggggcgagacataaaggtcgcggggcgagagcgtcacggcct

SEQ ID NO: 63 - DNA, 371 bp, Chryseobacterium sp.
taatacagcgttaatttttgaagggatatccctgagttatcgagagcttgatgaacgttccaaccagtttgcgcattatcttcgcagcgagtataatatagggagggaagatttggtaggcgtacagttggaaagatcgtctgattttgttattacgattttagggattttaaaatctggcggagcttatgttccgatagatccatcttatccctcggatcgtatagcttacatgaaagaagacagtgggtgtaaggtagttgttgattcagaggaattattgttatttaaagatcagcagcagagatatcctgttctgcccgttaagcatataatccacccgaatgacctggtgtatgttatttacactt

SEQ ID NO: 64 - DNA, 328 bp, Chryseobacterium sp.
tcttagctaaatgaaatgcctttgtgaacgaaattactttcagatcggattaaaaaactttgcggtccaagcgttaaaagaattttcatgatagcatttgggcacattattataacgcaatagatcgaaatttcttttgagaccgcgcactctttaagttcgctaaggtgtttcactcagcaatgaaagtaaatatcttagctaaatgaaatgcctttgtgaacgaaattactttcagatcggattaaaaaactttgcggtccaagcgttaaaagaattttcatgatagcatttgggcacattattataacgcaatagatcgcaattt

SEQ ID NO: 65 - DNA, 292 bp, Chryseobacterium sp.
tatctaatacacgtatgtatatcttgtcggatgggggtagtttatgtcctttaggagtagtaggagagatctgtatttctggggtgggagttgcacggggatatttaaacaatgaattattaacaaaagagaagtttgtttctaatccttatcttccgggcgagcgtatgtataaaacaggagatttgggccgttggctttctaatgggagtattgaatatataggaaggaaggacagtcaggtaaagatccggggttaccgtattgaattgggagagatcgagctagctct

SEQ ID NO: 66 - DNA, 258 bp, Chryseobacterium sp.
aagtgtaaataacatacaccaggtcattcgggtggattatatgcttaacgggcagaacaggatatctctgctgctgatctttaaataacaataattcctctgaatcaacaactaccttacacccactatcctctttcatgtaagcaatacgatccgatggataagaaggatctatcggaacataagctccgccagcttttaaaatccctaaaatcgtaataacaaaatcagaagatctttccagctgtacgcctacca

SEQ ID NO: 67 - DNA, 255 bp, Chryseobacterium sp.
tatatccacggttatctgtgcaaatctgtgctatctgcgggataaacaaaaattacccataagccgtactttctatggtttatcctcaatattggatattcaatagaggcgggctttagcccggtttgaaataaaccgttttcctttgctttatccgaaactataaataatagaagactatatccacggttatctgtgcaaatctgtgctatctgcgggataaacaaaaattacccataagccgtactttctatg

SEQ ID NO: 68 - DNA, 233 bp, Chryseobacterium sp.
atagcacagatttgcacagataaccgtggatatagtcttctattatttatagtttcggataaagcaaaggaaaacggtttattttaaaccgggctaaagcccggtcctattgaatatccaatattgaggataaaccatagaaagtacggcttatgggtaatttttgtttatcccgcagatagcacagatttgcacagataaccgtggatatagtcttctattatttatagttt

SEQ ID NO: 69 - DNA, 221 bp, Chryseobacterium sp.
tttatcgtctttccgaagaagacagctggcgcagatctattcccataggctttcctatatctaatacacgtatgtatatcttgtcggatgggggtagtttatgtcctttaggagtagtaggagagatttgtatttctggggtgggagttgcacggggatatttaaacaatgaattattaacaaaggagaagtttgtttctaatccttatcttccgggcgag

SEQ ID NO: 70 - DNA, 221 bp, Chryseobacterium sp.
tgtatttctggggtgggagttgcacggggatatttaaacaatgaattattaacaaaggagaagtttgtttctaatccttatcttccgggcgagtgtatgtataaaacaggagatttgggccgttggctttctaatgggagtattgaatatataggaaggaaggacagtcaggtaaagatccggggttaccgtattgaattgggagagatcgagctagctct

SEQ ID NO: 71 - DNA, 231 bp, Chryseobacterium sp.
ctcgcccggaagataaggattagaaacaaacttctcctttgttaataattcattgtttaaatatccccgtgcaactcccaccccagaaatacagatctctcctactactcctaaaggacataaactacccccatccgacaagatatacatacgtgtattagatataggaaagcctatgggaatacttccctcaagatctgcgccagctgtcttcttcggaaagacgataaa

SEQ ID NO: 72 - DNA, 161 bp, Chryseobacterium sp.
gccaacggcccaaatctcctgtcttatacatacgctcgcccggaagataaggattagaaacaaacttctcctttgttaataattcattgtttaaatatccccgtgcaactcccaccccagaaatacaaatctctcctactactcctaaaggacataaacta

SEQ ID NO: 73 - DNA, 161 bp, Chryseobacterium sp.
tagtttatgtcctttaggagtagtaggagagatctgtatttctggggtgggagttgcacggggatatttaaacaatgaattattaacaaaggagaagtttgtttctaatccttatcttccgggcgagtgtatgtataaaacaggagatttgggccgttggc

SEQ ID NO: 74 - DNA, 161 bp, Chryseobacterium sp.
tagtttatgtcctttaggagtagtaggagagatttgtatttctggggtgggagttgcacggggatatttaaacaatgaattattaacaaaggagaagtttgtttctaatccttatcttccgggcgagtgtatgtataaaacaggagatttgggccgttggc

SEQ ID NO: 75 - DNA, 138 bp, Chryseobacterium sp.
gtatgtataaaacaggagatttgggccgttggctttctaatgggagtattgaatatataggaaggaaggacagtcaggtaaagatccggggttaccgtattgaattgggagagatcgagctagctcttcaggggtatc

SEQ ID NO: 76 - DNA, 128 bp, Chryseobacterium sp.
gggggggggggggggggggggggggggggggggggggggggggggggggggggggggggggggggggggggggggggggggggggggggggggggggggggggggggggggggggggggggggggggg
